United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 10

SEQ ID NO: 29731 - protein, 463 aa, Pseudomonas aeruginosa
HRRHDAQPPFAVLAPGPGAGGVLPAIGMAVLDLGTQCRTEGLLPVRRSPLRLGGLCAASRTCLARRWPRGHRPLAGRAAPAGAGLGGRARRTVAIAGQSSAHHGGSRAPDFPAGRRLADELPLVVAAVHQPALPRTSGARPGGPASSRRVRPSRLVAGQAPGHPWPGAGRAGPAAGSVAVSALDSAAGTPASAGQCPARQRPDGAYAGRDQPAQRRAGRSGAGVRPYGRATRRAHGVAAPTAPRSLPRAAHAAGAPAGGGRGHAVRAAPARAPGAGGTGHAATGGQHPGAGLDGHRTPGIGAGGHFHPGVMGPAGGERTLRKRLGRRAVPQRSARGLCRAWQPQCTCPGPGEPAAQRHPAFAGRRRDPPAWSARRKLLVALPGRPGRGCGRAPVGDHLPPVHPAVFGTYRQGLRPGTEHCPSRRGAPGRPPMGGSRRSGAAPVPGAAFCLARRRCLYIWPICK

SEQ ID NO: 29732 - protein, 120 aa, Pseudomonas aeruginosa
PPTRSSISKRASADRATSMPAIPRTTTAPPIPRDSPTRVRRPTACIARTTPSPTTGPGRSALPGSSPSTTPPATTVWRRGWPVPSRGRSAPTVRSAPASWRTIASAANSTFRCMRCSSRC

SEQ ID NO: 29733 - protein, 199 aa, Pseudomonas aeruginosa
PPMAPSSFWSARKRAWRARAIWPTSCSAKAAARSSTSSPMATTRKPITTAPARKSGSRPAAASPISSAPWAPPGPSWASRATSRSRTRRCRSSACNPWRARPSRESDAGRRNTCRRSMTPVASTGSSTCTRTKPRTSCAGWPARKASSAACPPVGRWRRCCACPANWRMPCWWRSSATAATATCLPASMTRAEHVHGQK

SEQ ID NO: 29734 - protein, 624 aa, Pseudomonas aeruginosa
LAGADRRRAGPRPVLRAGQFLPAAGAPGGAGSRGGGRGGDGRAGRRQRAGQWPWQRALFPGRPVQSACRSALGGARFYRCAARSAARRRVRGGTRNEFSGCPEGSLCILQSGDPGARCWRNGQAGLSSEARRNPRYVSADRTCRGHGFVRGRLGCLRNPTSPFEGWRSHRWATRTVVKGRQDGTGESAPAGQHRRQYQPRGLAGPRPEPRPRARSSGLAGGLRVRSRIRAASDRRTELLGGRHVQLPDRTGNRRDPRGPQAGSGVPGRRGHLSRRAGRQDHPGSGQQAFRAGGGQADRGRAAHGRDQRQPQSAPFHGAGYPGAGGEPAQDAGGDGRRRSRRPDQAGRAHLRHSRGEERRRGKAPPRRPGSLRYLRAAGPPPGHRAYQVGAGGPVLPLPRARPVQADRQAATRAPAGSRAVHRQRDEPVEGSSRGHRRTGRSQRTGETHLFDLAQDAAQGPGLQPDLRRSRRARARSGDARLLHRAGHRAYPLAAHSQGVRRLHRQPQGKRLSLAAYRSDRPRGEGAGSTDPYPLHARRGGARSLRALALQGDRRQGQLQPLRGKDLLAAPGARMARGTGRHRWPGGATAGRYRAGQGLRLHSRRPCHRPAQGRDPAGFRLSGPH

SEQ ID NO: 29735 - protein, 281 aa, Pseudomonas aeruginosa
RPEIPMYRLDDLLHLMARLRDPEFGCPWDLQQSYATIVPHTLEEAYEVADAIEQGDFPQLREELGDLLFQVVYYSQLAREEDRFAFDEVVDGITRKLIRRHPHVFLDGDLYGKPDAAKLAEAAVKQRWEELKAEERAAKAKEPQQLSLLDDVPVALPALSRAAKLQKRAAQVGFDWPEALPVVDKVREELDEVLEAMAEGDEGAVGEEVGDLLFVVVNLARHLKVDPEAALRQANGKFERRFRFIERNLREAGRKAEECSLEELDSLWGEAKKAERSAPGC

SEQ ID NO: 29736 - protein, 159 aa, Pseudomonas aeruginosa
WENYRGSRAATASESAEDPTIEDDQQDHRQHRAEDSVGLRVGAFEALHLGADGIAAANGDRVGLVDAADAFAFDVLRCGRTPENAADPAIEAGQQAGAERPLDIAEENHPGLLGLVLHPVDEGFVEHHVFAITPRVGLAVDVDAAVVRIRRGQAEVVAQ

SEQ ID NO: 29737 - protein, 188 aa, Pseudomonas aeruginosa
AAEGVAVRIQVAAAGKQGEHRALDVGDAAHQLYGLRAELLGGGQRAVVPGQVEALPAFLEERAEAGFVVVQGSPDITLVEQVEGFFADGLPIVLQFVQLRKTAAIQIGLRGNAGEQVHQRVVGGEPGGVVDQLAQEGQARAPTEMDEQDAGDEQAHQSDFYQERNAHALLSMPSISGAGRSACGCSGR

SEQ ID NO: 29738 - protein, 450 aa, Pseudomonas aeruginosa
PPIEKDVGMPSSQLPGASPSEIDLVQLFQQLWASKWLIALIAALATAAALAYALLAVPTYQVDVLLRPIQTKALEAVNVNGLYALTPREALDRVGNELAAYSGRLEYFEAHPELFQQLNAEGLSPEQAFWKFNQDAFSMQQADLKKDPQAAPFFRLSMQYPQGMDGAAILNGMLASTIENERQRILDDLQARIDGRLQFLEQDIEGKRASYQATKEGKIARLLEADSIRRAGLEDELKALRGRLKMVRDSRIQQLNEAIQIATRLGIVKPTTPGALGEVGQDGSRSVFRTEVNNQQIPLYFMGVDALTAERDTLLKRKGDDFTEPRVAKIQQELKQLENNREVQYLQARKGEERFFENIDKLRGEQARLKTLKASELKIELVRIDQKASTPLKPIKPRKALVVALGLLGGLVFGVLVALVRAMLRAPRQRVQEDSLPPGVVSLDRSLSGT

SEQ ID NO: 29739 - protein, 219 aa, Pseudomonas aeruginosa
EFSIDTIRFQPKQGATSLSNMFLVDTIMARRYPMSAIALYDYLERLTSLMRAWSREQPLVAELQPVQLSALHYLARCNRYSDTPLGVTEYLGLTKGTVSQSLKVLEGRGLISKLPDARDRRSVHLRLTDAGRALIEAVIPPQFLEQAVTALGEKGEHLQGLLRDLLVVIQRQEDVPGFGLCRSCRFHQRRAGSPFCGLTGEPLSDADAELICREHQACG

SEQ ID NO: 29740 - protein, 341 aa, Pseudomonas aeruginosa
AGRVSSVSRNSMALRIANLLGANLMAGGRQGLAIQQGALFAQAQAALGEPAHGQRVDPVFFLVNPSGQAFRRILRLYRDYCLYDQWPPIEFLRHEVHAATVLAVAGFEGALMGMQPFVARQQRGMDIQQTPLVMANEIGAEDAHEPGKDHQVRFMGIDPLCQGLVEAFAIGIGLVIEHLGLDAGLACAFQAIGVRAVGDHRADPGRRGAVPEAVDQRLQVAAGAGNQHHDIAEFRHQWFFRLFRTTRSASAPQVSMRPICQGCSPAARRTSRAFSASLWATQMTMPTPQLSTRCISVSSTLPCSCSQSNTAGRFQLATSITAWALSGRTRGMLSSRPPPVM

SEQ ID NO: 29741 - protein, 141 aa, Pseudomonas aeruginosa
SGASLQAPSQRSVARHLYRRCSGGNASASAGRADGRWHIETARGFAGGTLMARICLHAYVGGRVQGVGFRQATREEADRLELDGWVRNLDDGRVEVVWEGEEDRAKALERWLGRGPRHAEVSAVEVEQMPLQGIAGFVVRR

SEQ ID NO: 29742 - protein, 367 aa, Pseudomonas aeruginosa
SGPGAAAVRAHRAGRHRLAGCVRAASARRAPHARYAAATGWRSRSAEGRRTGRRRIGAGVFRWASLRSAAEFFGDERHQFADRQVLRLAVTAALVFQDAFAEAAVADHDAVGNADQLHVGELHPGAGLLVAIVQQHFETGCGQLGIELVGRLLDALGFVLQRYQGDLERRQCAWPENAALVMVLLDGGGDHAGYADAVAAHDQVDRLALFAQDAQLHRFAVLGAKLEDMTDLDAALDHQGALAVRAGVAFDDIAQVGDLGQRQVALPVHAEVVLVLDVGASGEIAHQGDGAVDDAGDRQVDRAQRAGAGADGGTDLGLRSEYQRAGDQRLVGSLDFVELVITADDQGDQGAFFGAMHHQGLDGFLDR

SEQ ID NO: 29743 - protein, 300 aa, Pseudomonas aeruginosa
LEAVHQGRDGLGVGRVDQAHVLGGAAAGALARHGFGLLDVRGVVGAVAEDDIVLAGVGQHVELMGAAAADGAVVGLHGTEIQAEAGEDLAVRLVHPVVGLLQRVLAQVEGIGVLHDEFASAHQAEARADLIAELGLDLIEVDRQLLVAVQLVAREVGDHFFVGRAYAEFALVAVLQAQQLRAVLLPAPRLLPQLGRLHRRHQHFQGAGSVHFLADDGLDLAQYPQAHWQPGVETRGQATDHAGAKQQLMADYHRVGGGFFERGKQILTGTHLWPLCRLYREEWLGIVRCRSGCVQGAGHR

SEQ ID NO: 29744 - protein, 237 aa, Pseudomonas aeruginosa
NLIVIRLLQGLVAIELSVANAFVSTACLMFGVALYSFGRHLMGRSAGEARQAGAGGCVGLLWPGGEVSCAAVTAGPFPEGGAKLSMNDGRTGEVSMFALDPRLEQDTLLLGDFPLSRLLLMNDARYPWFILVPRREDVTELFQLDVDDQQALWREATLLAEVLKDTFRADKMNVANLGNVVSQLHMHLIVRRRGDDAWPGPVWGRHPARPYSSEQVEAIRGKLRMVLTDGFRFAGEA

SEQ ID NO: 29745 - protein, 69 aa, Pseudomonas aeruginosa
MELDARMDDLECRQAFQDDTLQALNDVVVEQQRSIERLQLQVAALIKRLEDVQGLVGEAGEDEAPPPHY

SEQ ID NO: 29746 - protein, 83 aa, Pseudomonas aeruginosa
RSSSRTALRCMKRKVRKEGRPMRVTHGGYLTGKQEATQIKRLAPEGEGGTLRRAPLSIERSTISWQEGCATSRRSFHAPAYVG

SEQ ID NO: 29747 - protein, 360 aa, Pseudomonas aeruginosa
RAWSRWRPMIEPDRLISAVSGRERDEQLDRAIRPLKLADYIGQPSVREQMELFIHAARGRQEALDHTLIFGPPGLGKTTLANIIAQEMGVSIKSTSGPVLERPGDLAALLTNLEAGDVLFVDEIHRLSPIVEEVLYPAMEDFQLDIMIGEGPAARSIKLDLPPFTLVGATTRAGMLTNPLRDRFGIVQRLEFYNVEDLATIVSRSAGILGLEIEPQGAAEIAKRARGTPRIANRLLRRVRDFAEVRGQGDITRVIADKALNLLDVDERGFDHLDRRLLLTMIDKFDGGPVGIDNLAAALSEERHTIEDVLEPYLIQQGYIMRTPRGRVVTRHAYLHFGLNIPKRLGPGVTTDLFTSEDGN

SEQ ID NO: 29748 - protein, 148 aa, Pseudomonas aeruginosa
ADMARVRHKRKPVAEMNVVPYIDVMLVLLVIFMVTAPMLNQGVKVDLPKVSSEALPQDNNKQVLTLSVKADGSYYWNVGSEVDTEKQTDSAVSLEQMTDAVTKIMSARPDTQVFIRGDKAVNYGAVVGAMGALQQAGVPNVGLITEAP

SEQ ID NO: 29749 - protein, 257 aa, Pseudomonas aeruginosa
RPGRKFLCMTGVAANNGGNVPPSGYGTAGAGGAFAGGGVTTPTSVQGELFMQLQQMQDELARLRGTLEEQQNQIQQLKQESLERYQDLDRRISGGGAPAAQNSAPAGAINANGAPAAPAGNNAPAPSSEPGDPAKEKLYYDAAFDLIKSKDFDKASQAFNAFLRKYPNSQYSGNAQYWLGEVNLAKGDLQGAGQAFARVSQSYPSSQKVPDSLYKLADVERRLGNNDKAKGILQQVISQYPGTSAAQLAQRDLKNLR

SEQ ID NO: 29750 - protein, 266 aa, Pseudomonas aeruginosa
SCMVSARLIFVPLHARPSGISSATTGYVPWRSFIYRNGGGRPVQSSRPWLNMQQTLRITEIFYSLQGETRTAGLPTVFVRLTGCPLRCHYCDTAYAFSGGDVVSLDAIFERVAAYKPRYICVTGGEPLAQPNCISLLERLCDAGYEVSLETSGALDVSRVDPRVSKVLDLKTPGSGEVGRNRYENIPLLTDNDQVKFVVCSREDYDWAVSKLIEYRLDQRAGEVLFSPSHHQVSARELADWIVADNLPVRLQLQLHKILWNDEPGH

SEQ ID NO: 29751 - protein, 229 aa, Pseudomonas aeruginosa
DEEFIMNQKKAVILLSGGLDSATVVAMAKADGYACYTMSFDYGQRHRAELQAAERVARQLGVIEHKVIGLDLNGMGGSALTDESIAVPESPSEGIPVTYVPARNTVFLSLALGWAEVLDARDIFIGVNAVDYSGYPDCRPEFVEAFERMANLATKAGVEGNGFRIQAPLQYLSKAQIIQAGVARGVDYGLTVSCYQADEQGRACGKCDSCRLRADGFAAAGISDPTPYF

SEQ ID NO: 29752 - protein, 108 aa, Pseudomonas aeruginosa
LSFKYYWAKFFWGAFFFVLVAWKGSVFPSLASVNPLVVAGLSTILFPFSVKLVEDFALKYTEREFWVTGFFSETPAKTGLYAVFYLSCYLFSIPLGMVFLFYKYGKAS

SEQ ID NO: 29753 - protein, 96 aa, Pseudomonas aeruginosa
SPFSEQKTAVKKRFTEEQILDFLKQAEAGVPVKELCRRHGFSDASFYTWRAKFGGMTVADAKRLKDLELENSRLKKLLAEAHLDIESLKVVARGKG

SEQ ID NO: 29754 - protein, 64 aa, Pseudomonas aeruginosa; identical to SEQ ID NO: 19150

SEQ ID NO: 29755 - protein, 135 aa, Pseudomonas aeruginosa
PSFKHIDGVCMKELGSESPMESLFDIRSLEAITGGEPAALQRLLETLLASSRDDRTRLAELLELADLQGVAELAHRIKGAARVVGSSLLVESCSCLEKACQNPSESSERIANLASSLEGKLSAFEISISTELAKL

SEQ ID NO: 29756 - protein, 858 aa, Pseudomonas aeruginosa
LPLWMGVSVLSEISPRNIRVAIFRKKFDFELSVYSRSSCLMALGLALPAVTFAVEFNAEFLNNEGGAPVELKYFENGNSVSPGTYSVDIHLNQIMIRREDVVFSADPETGSVRPVVRIGLLKEIGVDIARLTRDKLIPDNLENNTPLNVAELIPGASIEFDVNSLSLLVSIPQLYVQRHSRGYVDPSLWDDGVTALFSNYQANFTRNTNFGQNSDYRYLGLRNGFNLFGWRLRNDSSLSGGTGMRNKFSSNRTYVERDIRALKGTLSLGELYTSAQGDAFESVRMRGVQLQSDIGMLPDNEISYTPVVRGIAETNATVEVSQNGFVIYSTNVPPGAFEITDIYPSGSNGDLEVKIIEADGRQRSFKQSYSYLPVMTRKGNLRYGLAAGEYHNDGQPSVNLLQGSAVYGLSDRVTGFGGLLAAEKYNATNLGLGFNTPLGGFSADVTHSQSRTRRGGRNQGQSLRLLYSKTINATETSFTVVGYRYSTEGYRTLSQHIDDMSEESYLYGSSSSRQKSRIDLTVNQTLFRRSSLYLTAGETTYWNRPGSSRRVQFGFSSGIKRASYSLAVSRTQETGSFGRSDTQFTASVSIPLGGSARSSQVYANAVSSQHGDSSLNTGISGYLDEANAFNYSAQANYSKDGGNSGSVGLGWDTSKAKLSANYSQGRDNKQINLGASGSVVVHSGGVTFGQPVGETFGLVEVPEVGGVGLDGYSSVRTDGRGYAVLPYMQPYRYNWVNLDTNTLGSDTEISDSTQMAVPTRGAVIAKRFSAESGRRVQFDLSMDSGGKSPFGAQAYDKEERVVGMVDNLSRLLVFGIEDQGRLSIRWSDGSCSVDYQLPPRNKDLTYERVALSCRRSSI

SEQ ID NO: 29757 - protein, 529 aa, Pseudomonas aeruginosa
SGCISLKRERSVMSTLANLTEVLFRLDFDPDTAVYHYRGQTLSRLQCRTYILSQASQLARLLKPGDRVVLALNDSPSLACLFLACIAVGAIPAVINPKSREQALADIAADCQASLVVREADAPSLSGPLAPLTLRAAAGRPLLDDFSLDALVGPADLDWSAFHRQDPAAACFLQYTSGSTGAPKGVMHSLRNTLGFCRAFATELLALQAGDRLYSIPKMFFGYGMGNSLFFPWFSGASALLDDTWPSPERVLENLVAFRPRVLFGVPAIYASLRPQARELLSSVRLAFSAGSPLPRGEFEFWAAHGLEICDGIGATEVGHVFLANRPGQARADSTGLPLPGYECRLVDREGHTIEETGQQGVLLVRGPGLSPGYWRASEEQQARFAGGWYRTGDLFERDESGAYRHCGREDDLFKVNGRWVVPTQVEQAICRHLPEVSEAVLVPTCRLHDGLRPTLFVTLATPLDDNQILLAQRIDQHLAEQIPSHMLPSQLHVLPALPRNDNGKLARAELRHLADTLYHDNLPEERAC

SEQ ID NO: 29758 - protein, 356 aa, Pseudomonas aeruginosa
PWNWREKLMHKVKLAAITCELPARSYENDDPVFAAVPDLSESWWQFWGVNRRGYFDPRNGENEFSLVVRAAERLLRSSDTAPDSVDMLICSASSPIMTDAGDVLPDLRGRLYPRMANVLSKQLGLSRALPLDSQMECASFLLNLRLAASMIRQGKAEKVLVVCSEYISNLLDFTSRTSTLFADGCAVALLTRGDDDSCDLLASAEHSDATFYEVATGRWRLPENPTGEAKPRLYFSLFSDGQNKMASFVPTNVPIAMRRALEKAGLGSDDIDYFVFHQPAPFLVKAWAEGIGARPEQYQLTMGDTGVMISVSIPYTLMTGLREGKIRPGDRIVMAGAATGWGFAAQVWQLGEVLVC

SEQ ID NO: 29759 - protein, 351 aa, Pseudomonas aeruginosa
GIAMLNHGVRGGLHMGNPILAGLGFSLPKRQVSNHDLVGRINTSDEFIVERTGVRTRYHVEPEQAVSALMVPAARQAIEAAGLLPEDIDLLLVNTLSPDHHDPSQACLIQPLLGLRHIPVLDIRAQCSGLLYGLQMARGQILAGLARHVLVVCGEVLSKRMDCSDRGRNLSILLGDGAGAVVVSAGESLDDGLLDLRLGADGNYFDLLMTAAPGSASPTFLDENVLREGGGEFLMRGRPMFEHASQTLVRIAGEMLAAHELTLDDIDHVICHQPNLRILDAVQEQLGIPQHKFAVTVDRLGNMASASTPVTLAMFWPDIQPGQRVLVLTYGSGATWGAALYRKPEEVNRPC

SEQ ID NO: 29760 - protein, 213 aa, Pseudomonas aeruginosa
PPWPLPNAKGESAMRITLLDNFDSFTYNLVEQFCLLGAEVRVMRNDTPLPTIQAVLLADGCELLVLSPGPGRPEDAGCMLELLAWARGRLPVLGVCLGHQALALAAGGAVGEARKPLHGKSTSLRFDQRHPLFDGIADLRVARYHSLVVSRLPEGFDCLADADGEIMAMADPRNRQLGLQFHPESILTTHGQRLLENALLWCGALAVRERLRA

SEQ ID NO: 29761 - protein, 330 aa, Pseudomonas aeruginosa
AALRRFDDARLPGRRIVETLAAEFAQALAGAFEKAQEAALGFQRGVVVAIHLGVDAARFVEFAEDCQGTVAQAFLDEIMRRDAPSDAGFHQTQHVVEVFHEEHLVADRPQQVRMLPGAAAEADLPVIGQARDAVQGGIAQGVLRMGDDERLGVAEHALVEAGYLQFLVDGDGDIDFRVVLLDRRQAIGGRGAYQADHVEIVEQYAAHRIAERRRDGGVQQHPEIARTLVEIEGDVADQLLVVQQAAHVRDQAKRLLGGFDLVAVPTDQLHAQVDFQVADRRADRGVRLAQDPRSGGNRTGGDDLEEHVHVIQVMNRHPLFLLLGGACRFP

SEQ ID NO: 29762 - protein, 244 aa, Pseudomonas aeruginosa
RPKPMSFVSGATGQAGTDAGMALARPMRLESAALQADPRGLLKGDTGAVPETCNRQFPAVQPAAGYKIERRAVAPSGVATMTHISERLLVQAHLAAKQPRVLSEQESAEHRAAIAAELKAQNAVLVAHYYCDPVIQALAEETGGCVSDSLEMARFGNQHPAQTVVVAGVRFMGETAKILNPEKRVLMPTLEATCSLDLGCPVDEFSAFCDQHPERTVVVYANTSAAVKARADWVVTSTCAVDIV

SEQ ID NO: 29763 - protein, 137 aa, Pseudomonas aeruginosa
RRSTRTPPFLVHPESPESVVALADAVGSTSQLIKAAQTLPNKTFIVATDRGIFYKMQQLCPVKDFIEAPTAGNGAACRSCAHCPWMAMNTLERTLACLREGSGEIFVDPALIPRAVRPLKRMLDFTQAARLRQAGNA

SEQ ID NO: 29764 - protein, 392 aa, Pseudomonas aeruginosa
TAARRGRRRRLSILAAQALAEPSPFRFRISDDQGVTRLDAALLLRRGGSGAGDHAGARLQRHPRLRRDARAGTGGDGDRLPDPGRGRHAGTLPGAAPVRRVAGLQPVPRLAGAVPGGPAAAALAAIVHPVQRTAADARRMAERAADAARALSQPDQRGAGAQGHRDRARRIRPDRPVGADLVAGQPAGGGERHDLPGAGADPGVLLPQGQEALPDLVPPLPAARARADETGLGRDEPADRQLHSRQGHRDRHYRRGDLHRLRLPGAQLRSAAGPAGRPVGGGAVHRRGGGERTGGDDRLLPVGLERPVHLPDGGPRDHPGAGWQRAGAAAVLRGGEPAPGGDHLRGVAVRRALGLLGRVLRDPPGDPGESGAGCLAQGPSRDSGSHAIASAA

SEQ ID NO: 29765 - protein, 230 aa, Pseudomonas aeruginosa
KMQKAADAAFFSGRGSGAVERLGGGENRVDMPGHLHAAPLLAQYAVPVDQEGAAVDAHVFLAVELLQLDHVEQLADRFILVADQLEGEFLFALEVLVGLQAVAGDAEDLGIGLLERRVLVAEALALGGATGGAVLRVEVQDDLLALQRGQGHLLAAGCGGGEVGYGFVDCDRHGSAPQGCWGRQGSIRASRFRASAKSRNWSRSQLIWVPAGSVTVIVALSMVVLVCGAW

SEQ ID NO: 29766 - protein, 240 aa, Pseudomonas aeruginosa
AEPIMEKREELYRGKAKSVYQTDDADRLILLFRNDTSAFDGKRIEQLDRKGAVNNKFNAFIMQKLEAAGIPTQFDKLLSDTECLVKKLDMIPVECVVRNFAAGSLVRRLGVEEGIALTPPTFELFLKNDALGDPFINESHVQAFGWATPEQLAQMKTYSFKVNEVLNKLFDDAGLLLVDFKLEFGLFHGQIVLGDEFSPDGCRLWDKETRKKMDKDRFRQGLGDVIEAYEEVAKRLGVPL

SEQ ID NO: 29767 - protein, 70 aa, Pseudomonas aeruginosa
SSRKNSYESDSANCVDRGSISFRLLYPRFKGSKLCPLFCNLFFYFFISAHCFTSIPASRSAFTISARSRC

SEQ ID NO: 29768 - protein, 137 aa, Pseudomonas aeruginosa
GLPISLRQGRCLTRSNLPAGRPAMTEFMQILIFGSSLAMAYFLGATSSRKSSSEIRLIDKWPTAYIQFDSGMSQEDALRFLELAREMVLAGPEKVTAENALKDDEESRDAFWAQSLKTGLASFESRSKSSHSPRDPQ

SEQ ID NO: 29769 - protein, 155 aa, Pseudomonas aeruginosa
SMKTPVLETRRKVVTTVANAYPGGRDCAAARLGIPLKRLENQMYETAGVKPLSDGDLYVLEQEMGTSYLPDYICAMYGGVFVRTPEAGDLDNVDLHHRSLRTAVKRGRVDQMIALALEEGEISADEAKEILALHAKHMAARHEEVRAVLELHRAK

SEQ ID NO: 29770 - protein, 480 aa, Pseudomonas aeruginosa
QPPARSSASWRASTMPHERPLVAMEAEQGVLGALMKKPELCEVVGAFLSPTDFSHADNSVIYSLILACHSKAIVPDPLSLAEARSELPSGAFTLAYANDLWREVASTASAENFARIVVERAKARELYEAGERIMNIALQRGKIPDQVAEAQSIVLDLNAQDETPDVVTLREAMLPVFDEMEVRWKGTQSVGLKFNLPDLDAVIQGLRPGNLAIIAGRPGTGKTVLGVGIADEIAVRNRGAALIFSLEMSQAELAKRSLASLSGVSQAAIDSGKALECQDSIARMTAAVDQVSRGDVRICDKGGLTFSRICSIARFQHRAKPLSLIVIDYLGLITSDPSHRHQNRNQELGAISRGLKALAKELGIPIVALAQLNRSIETRADAKPKMSDLRDSGEIEQDADVIIMAHRDMSTERGQNGITELDVVKCRHAKPGFCLLQFQGEFARFVSCAQDREEQQEQTVRPQRPSARSMVADFKPRGAQ

SEQ ID NO: 29771 - protein, 94 aa, Pseudomonas aeruginosa
GSRRQAGGGRVMPNYRKPDMYSDADWEMVQGYMAGKDGLRAQRSTAAYMHGYRNGVSDRTGVPHERAEVLRRRAEMIPGITPDKVWFQGRVGRG

SEQ ID NO: 29772 - protein, 256 aa, Pseudomonas aeruginosa
APEADHRGHQGTEGQVPGLGARTEEGNGMNLNSARIAWHDAFYTPWNSGMAEAAERAALGIVEAGGYVRRRITEIDDDGEAVSYSQHTFVPGIHQTRTERDISTPRAVHQALAGMIQKAIDTLPAHLKVFGNHMYSPMAGEDEKEAAEEIVFKVAYETGPRMYTKKFEKARYVAAGVLFRYRRMHQGGQSEGVDPCPSPESFRAWLLQIHGLELSSEQWTREWDGFIQSCFDACNDLDKGALVPVSSAIKMMKNAA

SEQ ID NO: 29773 - protein, 145 aa, Pseudomonas aeruginosa
SVQTATESGRMRAATNQHLAHKSALATKSFWVATTRPRMVKGGTRPYRDLILRDRLGHAGVKVKWEPVEARHGVNAQADALRGYAAATFSGRYSQFTAMPDSAPVTPNHACGRRRQGSPLVIKAKAPAPCSAGVTPASPAPIPRL

SEQ ID NO: 29774 - protein, 175 aa, Pseudomonas aeruginosa
HIMAILVDLLEDGVMTDFLEIREAYTKYKAAQDAYWSDLQKKAWAIYIGFERHLRLDQHKVTVPGEDAQPYVQVGSMDGDRFVRALAPQFSGADGKVEFTISLLVDEHPTSYPKKRILIQASIGKESGRYMVEIKGRSGPITVSIGPDFPSDQLGDLYEMIARDVIASMDPSAFA

SEQ ID NO: 29775 - protein, 101 aa, Pseudomonas aeruginosa
RTALEVVMVDPWTLVAAMICGAICMRLATYRRQGARYRRGVSWLAYLLCVGSGCFALSVMLDALHGYRLNPVSPWLTLVLAILLGLVCRARGNLAHILRVY

SEQ ID NO: 29776 - protein, 90 aa, Pseudomonas aeruginosa
RNALMKSHPIPVGVEVNPNRPWTPDDIAGYSGEVVSAMKVLEPLLRSGLLALHPDEWQGGKLSFLRPAQARRQGWTPPVQAAGNQVSRSA

SEQ ID NO: 29777 - protein, 143 aa, Pseudomonas aeruginosa
DTAPPKHFPFPQNLGFKMARHKQPDVVAKFKGADKKNPQRYRQEPAKGEGEVGEAPIHLQGPARLAWKELCAQSIKGVLTGSDRIILEVTANLLAEYRANPTEFAVGKYTHLIGNLARLGLTPSDRQKFGLEKPKEKDEFEDF

SEQ ID NO: 29778 - protein, 297 aa, Pseudomonas aeruginosa
PMTLRNLPAAPEARPRSGVQCDLAPKALDAWRPELRAASGDNPDSTITIYEPIGYDWWTGEGVTAKRIAGALRAIGSDVDVTVNINSPGGDVFEGLAIYNLLREHKGKVTVNIIGLAASAASFIAMAGDEIHIGRAAFLMIHNAWLIAMGNRNDLREIADWLEPFDMTLADIYAQRTGIDIDDIVKQMDAETWIGGREAVDKGWADAFLESDEISSAPSNRSEAILAKRRMDAALARSGMPRSQRNELINDFKTSMLGAAGGGGDTPTDMPGAVAPDLSAALRAAQDITKFLQGESQ

SEQ ID NO: 29779 - protein, 215 aa, Pseudomonas aeruginosa
CIPRIRAPGAPVGGPRLVPDCGIRDPKACGWRVAACIASGPSLTAEDCERVRRWRAAAPQRAAICTNTTFRLTPWADALWAMDKAWWERYAAEAKANFCGELLTLSANPFGIKTARIEHYRNSGGGAVSLAIARGAKRIILLGYDMQKTNGQSHWHGDHPKGLGSAGKIAEWPSEFERLKRNNPTIEIINCTRETALTCFARLPLEEMLNEPDPA

SEQ ID NO: 29780 - protein, 285 aa, Pseudomonas aeruginosa
WIDGRTLGGRLFIRGMLGLGDNIYARAFVKKHQGAYLETPWPQLYSDIDVKCVRPYTQLRTQAKNVQRPAQWHKPFGGGQLRIAYGQMPIIQGLRQAFRCEPGAFDLPDFGPSPVEGRYVLVRPATVRAEWRADTRNPLPEYIASAASEMRRRGWRVVSVADLEPGKEWALAPLPPADIQFHKGELPVEQLLALLQHADAVIGGIGWIVPASIAAKVPAWIICGGQGGYNSPEHITDKCMDLSRITFAVPDRFCRCTLKQHTCDKRIADHDARFAAWADRLPALV

SEQ ID NO: 29781 - protein, 102 aa, Pseudomonas aeruginosa
RKKLTPADEVWHELVLNGIGGCTIREAKERIDYDEYRAWVAYLKKRGSLNGSYRLEWVLAQLAAIQAKVGGVKCEPDDFRPHVRGPVEPVGISLEQAMAAWV

SEQ ID NO: 29782 - protein, 80 aa, Pseudomonas aeruginosa
MSTFACESNMRELSMSTGRPIEELKQVVVTELMVKAAMDYVLGLWDRDVDIFLLEDVFRIMAVLQPRPLDIPKLTSAPSQ

SEQ ID NO: 29783 - protein, 307 aa, Pseudomonas aeruginosa
PRSARFLPAWQSLGPRRIYSLWFLGLPFRLPPRPLVSSKHGKLPPEQTCCHWHFIHAVQPSSPPRAGFFISGERMAFNADVQKLEPGNLIRLFEVDATRLGGNLWRFHGHAQEGEIIWQGNVYEPIQITAKGFDIRGDGRPASPTLQLANELAGIRGAISAICLQLRDLCGARVRVIETWRHYLDSANFPDGNPDAADEARVGIWFIEQKTEETREQVTFALSSPIDMEGQMLPAQQITKLCRWACRGQYRGEACAYTGAALFTKKDEPTDNPALDRCGGRWSSCKLRGNTNRFGGSLGASLIVSSR

SEQ ID NO: 29784 - protein, 135 aa, Pseudomonas aeruginosa
SPRSTSSPRWASSSSPTSIRCRSISVACRARSIICPMCWPTTRRRPTRRTISCGSATGCIRQSRRCRSTPRRRTRPTGPTSDSRSRRPTAWPSRWPPTPRISPSSTVRSKRRLRAWMFCRLPPAGSRRPERRPMR

SEQ ID NO: 29785 - protein, 273 aa, Pseudomonas aeruginosa
QENSMAWYSTGTVAVTANSPTVTGTGTQFSSNARVGDAFRGPDGRWYEVTNVASSTVISIKPNYQGSTASGQAYAVAPMLGYDKDLSDRFNLIANQWGATLAGIKPWALSANAAAARGDLGLGSAAVREALGSSGALYSRDSILGAVSQSSGVPTGAVIDRGSNANGEYVRFADGTQICWTNTLTFTAGVTSVGANWSYPASFSSSYPIAGAVSASGAGGDYDSGVSARNQGATYFNPSAGTAGVGFFCISSASFTSGAQTRNNRVVAIGRWF

SEQ ID NO: 29786 - protein, 154 aa, Pseudomonas aeruginosa
PAWWRTSTTVPVAWLRPGRAGTSAPTASPTPWRSAWRATPEPSPTTPTPRATAMATRHRATAGGTAGAGCYRSPAGRTTAPPAPGLGQPLEQEPELLEQPEWAAISAAWWWASHGLNDLADRGEFAAITRRINGGLNGQAERLALWERAKRVLS

SEQ ID NO: 29787 - protein, 165 aa, Pseudomonas aeruginosa
IYSGLPERTTGGGSSIRFGVQRDALCSKGRQEQRRNLVADLPDGSTPGPEAQYLAFLAQGRFMLQRSRSSGRHVFYPRQLVPGSGETDLEWVPASGLGTLYAITVNRSRGGNHNVALVDLDEGVRMMSRIDGHQSLPIGTRVQARIVEQDGANVVVFVPHQEGRP

SEQ ID NO: 29788 - protein, 413 aa, Pseudomonas aeruginosa
WTSPTSPPGRIYPVGDSLRMITVSGGAGIIVSDVAEEVGLPMPPMPDMAQERLKARLSFASPINPVDCTAQALNDLTLVRDFTESMVVDGGYRSLLAFFTQAGTAASIGARLAEQFRRIKEAHPERLFVVSVMGEGEELAPYEEAGFALFEDPTRAVVAIQAMGRLGEAFARPLRLRRPAGGLQLPASTPGEAEAKRLLARAGIESAAEAVLGSAEEAVAFAEGIGYPVVLKLASADIQHKSEIGGVLLGVSDADAVRAGFQLLLRRAAEKAPQARLDGVLVARQLQGGVECFMGIQRDPLFGPVALFGLGGIFVEVLQDVVFRRCPFEVDEAEAMIRSIRGAPLLFGARGRPRADVAALARLLSNLSRFAWEAGERLRSVDLNPVIALREGQGAWAVDAVLEVDEVADGARS

SEQ ID NO: 29789 - protein, 159 aa, Pseudomonas aeruginosa
GTPELPDPRSTPALQPARQRLLRIDPRSGRRPAGRAPAGLRRSVPRSPGIAVHGPGARSSGLLAGQSGDWRGRAAPGSRRAAPGVAAAVAGGRRGDRPDPGHRSGRQGRRQGRAALQREGAQRRAQRRGAGCRPQHHLPSRRRRLRWFPAGAGNAASLA

SEQ ID NO: 29790 - protein, 745 aa, Pseudomonas aeruginosa
TDTRPATRPADPSGAGPVLPPQRRRQPAPRGARGSAAGRLPAADPAWPVHPRRGIPRGVARARRLPRGATGTSAGAFLGSGVSRRDLAYRDVERRLVPHSRRRARCGGAGQRPGRSAARAAGLKRRAAARGNDRRAAVKINRNPACENKNNECNRAFTEPGAGHFPAHHADRLRLLLPRPARRRRRPDVPGLQPQQPEGRIRPEQLRSRLPRQPDSRRHGRRRYLWRLVLRPLRPGASGDLDHRAVLHRYRVAGADPELLAVRADPLRRLARPRLAVRRLQHPDVRVRRNQVPHHHPRRHAGRLDRGLPGGDPAGGADHPRVRLARLVLHRRGAGAGLPGPAALGAGVAVLARGPGRAPASRRGSAEPRRGWRRRPAGTDAGRSGNARHVPALEPHLLLPAVRLLRHQQLDAVLPGERVGDELQVDDRLHGRHLQRDDPRQGRRRRLRRSLRSAPDLRRRGHRQCRFHAVDRVLPLALQHPLDPHHLRLHLRRSGRGAGHLHDRELLHPRPRLGSGHRLQPGAYRRGGGARRHRPAGHPRVDRRGFPGDGHHLRAHRTDPGAVHCGPALRPEPRVPRCRERFPTASAGQCRGYRRAARGQGLILRKECTSMSSFPRQPAAEQRPASFQEFIGLERWTDADGVARVRLGHRPELMNYLQQFHGGVLMSVLDAAMAQAIRACLPDCSMVTIDMATHFMGSARGELRAVGRVVRRTRTICFCTAEICNEDGEVIAMASGSFRYRAAKP

SEQ ID NO: 29791 - protein, 401 aa, Pseudomonas aeruginosa
RISGGAAAGAIRRASGPRPARSLRADKPAPPVQMTDGRTAYRQEGEQMSEQDEWAGEREQRLRMIRDSAASLVPRDGDLTRVRRGRFTGSGVDRQAWREVCAMGWPALRLDEALGGSGLGMSEYAALLEALGRGLLPEPLIEAGLVAPLLPEDERVALLAAERLVLPAGIAYRDGRRRPRMQQGRLHGEVAHVHLAGAADAWLVACEQGLALVERDADGVELLCEATQDGAHLARLRFRDAPARWLSGEVTEQVLDEAALACAAYLVGLMDGAFERTLEYLKVRRQFGREIGSFQALQHRMVDLRIQIELSRAMVEQAAAAIDAGASESERQRQVSSARVRASEAALLVTRQAIQLHGGIGYTDEADIGLFLRRAMVLLNAHGSLAFHKARYAALLQREVA

SEQ ID NO: 29792 - protein, 429 aa, Pseudomonas aeruginosa
PRRCSPRALTYCWSGRASCRASCFSAPTTPRARRPFSPSVPPYSEETEMSDYDSLDDNAFRLMVREWIAANYPQRIRNPPRRLGREETREWYLLLSRQGWLCPGWPREYGGMGLSAGKQLIMMEEMEEYGCARLPDSGVTMLGPLLIRYGDEAQRARFLPRILSGEDIWCQGYSEPNAGSDLASLRTEARLENGEWVINGQKTWTTMGSEANWIFLLVRTERSAKAQHGISFLLVPMDSPGIEVRPILNLELHGEFCEVFFNDVRVPYDSLVGGINQGWSMAKALLGFERIFLGSPKQSTFALQRLERLARHLGLWHDPLFVRRFAALSMDLDSHKALYERFAERLRRGESLGPEVSMLKIFQSELFQRISELGLEVAGEDSALLQPFAEDPELHPAGIFIQSRPTTIYGGSNEIQRNILAKSVLGLSG

SEQ ID NO: 29793 - protein, 371 aa, Pseudomonas aeruginosa
RARLDPGEHRRARHAGVARQLHGPGAQPGRVLLGPDLTEEAIHGRVQDPFHRDLRRRTPDHAGRHAVGRPCRDGCGGGQRRWPGDAVGVDPAEPGGTGCGDCPLPRADRSAVRGQPDLAADAEAGALCRISRSPPRDGNPPSSKTAGNDPGEHIAEFRRHGVKVIHKCTAVRHALKAERLGVDAVSIDGFECAGHPGEDDIPGLVLLPAAANRLRVPIIASGGFADGRGLVAALALGADAINMGTRFLATRECPIHPAVKAAIRAADERSTDLIMRSLRNTARVARNAISQEVLAIEARGGAGYADIAALVSGQRGRQVYQQGDADLGIWSAGMVQGLIDDEPACAELLRDIVEQARQLVRQRLEGMLAGV

SEQ ID NO: 29794 - protein, 442 aa, Pseudomonas aeruginosa
SAPPRRSRQGVLAAPCLSTDDEETTTMKILPVPMLAAGLALLPSFAQAEFFADGKAGLELRNFYFNRDYRQPGASQSYSEEWAQGFLLRYESGYTEGLFGLGVDALGLLGVRLDSSPERSGSGLLPYSTSDRRAAHDYSSLGLTAKLRVSHSTLKIGSLMPRLPVVQFNDTRLHPQTFQGGLLEVNEIDGLALQFGQLRQVKQRDSTNAEDLGITRGNKRNVLAGRHPGSDRFDFAGGTYRWSERLSSSYHYANLEDFYRQHYLGVQHLLPLTDDQSLKSDIRWARSTDEGGSRVDNRALNALFTYRLGGHAFGLGYQRMSGDSGFAYLAGTDPYLVNFVQIGDFANKDERSWQLRYDYDFAAIGLPGLTFMSRYLRGEHIDLLDGGGRGKEWERDTDIAYLVQSGPLKNLGIKLRNGTFRSDFGNDIDETRLIVSYALPLW

SEQ ID NO: 29795 - protein, 177 aa, Pseudomonas aeruginosa
GARKNRLNGEKLNPTGPGGWGVIASRRLPRQGARPTPRGPLGGTPTIQPDTALLEQQGVLKKATARCAVQAGRGRGAAGPAGAPDRGARGGRCRCPRGGPRTLYPAGGARPDPRRSEGRGNDPGQGGELGAAQRLPGLGLAHQLRRRRAPALRVALLRQRQQQPDHRLRRTQRRRSL

SEQ ID NO: 29796 - protein, 410 aa, Pseudomonas aeruginosa
RQPEYQLGPAAAAQYPRGPRQPGAPARAFRPQGGAVGKLERRHPHRHRFGQQPGVDHPDPRRRLRQEGPLARPGLPDLEAQRAPEPDRRADRQSVPVHRPAVFQRPQLRRRGGDLQPAAEPRCLAVRHGRRVPRGVQLGHRLVERFRQGRQRQQVDVRRAIGRHLEDQPAAQPYRRAGLLPLRRYRRAAFQPLPALGRRSGVRHRRQPSDLHAEGQHGVPPARHRAQPGRPGEHAEPAVRRPGLGVQSARPEPRLGCRATQRLQAAGGRQLRAQPGLRRGRHAQARRRCGANRQQPRLRRRHQERGERLDAPVHPGQRPGHARRRRLAGLRRLQVHPAGCPAGRFQRFHLPPWRDQRQGLHPRRQLWLRQARLRYRALAQLRRGLRRTVLHRRPATRGQHALLSAPRGRP

SEQ ID NO: 29797 - protein, 196 aa, Pseudomonas aeruginosa
NSKRWRRSSATTSTRPRSRTARRRSPSEIRQQTRNPDMNDITLIEHLSVDSLTEALQDAGYRVNRSEQNGVVQLLSASQGIGYAVRFGNPAATPASYLDFTFSCALRVQGELPAGLTERWNLSRRFGRLSQQGEFLVMEMDVIVAGGVSPANLRSHIELWDRLLQEFIAYLRDYSRLAAEQQGMAQDAGQPVDGEA

SEQ ID NO: 29798 - protein, 457 aa, Pseudomonas aeruginosa
ADAAGISLRCPGVRACPSRRLWPARGRRRGPGPGRACQAICQRRRGARGGPPRRLAGGAGRTEGAAGRGAGGNPRAVEREPRRTGTLDACATGREGALRTGQRPGLATASAGEDVDRCGGAADRPAYLPGVGEHGARGLPQRCRTAGRLPGEQGATGCTGAVPGQPDLHRRLCGRRACRSAQARPGTLPAGRGRRLRRTGAQAFRRPADRPQRRRHRWVTGAGATAAGDPSGAGTAEGRRGVRADPGRQRFPPGQADRASRRPPRHPRRGPWSPARKPARATPGADSQGLPGWPGEQRYPEHRRRVARQDPGGTALMDGIPEARRGPRASRWRHLRSWLFGEPERFRDERQRLWGAYAAWLDEQVQQRLGEDAETAPRLLAFLESRRAAGQLPNTDIDLRVWLDERGWIVRLACLRSDAEPIENELRRALMDRSLRLPPPEHMPQPIELRIRLMPGR

SEQ ID NO: 29799 - protein, 331 aa, Pseudomonas aeruginosa
RGSMALSESAGQRPALLRPAQGRDDRAYWHELFGSLEVVHFFLVTARCGCFMQAARSLDVKPTLLRKTLARLEERLGLHLFVHEGNALSLTREGRIVQAAGQRLVEDSQSHADLHRQQPLVRLAVAESVLHDVLSRELWGYLRKNANLRVALAELREGWPESAGPAEIAIWIADPGQPHPPMEGHFAAPARIAELEYQPHIGKRYSRERTRPASEDELDDYLLAQLHGQAASAALAPWNRRVAARQSGVIEVQSHDLLLQAILWGACIGLLPHYAGRLERNLAALPQVFDEPMRREVWMSVQPEAENRVEVRALLDLIEHAFDDRRDWFGR

SEQ ID NO: 29800 - protein, 276 aa, Pseudomonas aeruginosa
RVGHRAREKSSTSFVQPSGRGLALFPVPVQGGDIPGTQQWHGCLDIGQWPVPPGHFQQVLDIAIGKALTNGPGRVTADDGIGLDIAGHQRAAADDGSVADPYAGHEHRLGTDPDVMADQRVARWLIAVHGAGEGRLFVHEVEGEGRRPFGAVSLVAGHDEGGATADRAETADDQLVHVVAVRHQVAGAVVEGMPVIVAGVVAVAPHPYVRVADLFREQLAPEGALEIVAHDRRPCPSKLPRVAPGGIAGQPGVTAGSRVGVQQAGLLNGQAWKGSE

SEQ ID NO: 29801 - protein, 114 aa, Pseudomonas aeruginosa
HGPRDRFQPHFTRKDSMTYHVLVQFDVPSDKREAFAAAGLFDANGSLQNEPGTLRFEVIRDENNRNRFYLDEVYEDEAAFLQHCRNETIARFYELIDSYAFGPLFLFKGYRIEG

SEQ ID NO: 29802 - protein, 61 aa, Pseudomonas aeruginosa
RRMLMVMRLFGLLLAAFLMSGCSVRVPGAYVELDPFDDGYYGYDRGGPPHCPPGHAKKGWC

SEQ ID NO: 29803 - protein, 262 aa, Pseudomonas aeruginosa
ESRFFCFSPAWVAARCMTTTTMTAIGATIAASPTATPTKCRAIACMTMAGAANGATTRRATTTNATTRRHAATMATATTGASNIATSSATTNRARPIVASGIRATGSAAASRNGAGILRNAGNNTVGRIVRDTRASRAGHLAGATEVRKERRRLRAPSCFPVESADPLGAFARHTLPIPKRGGSHESFSVVRQGRPGDVLARRAGQPGLPAGRVASTDPAVVRRAGAGPCRRDPAAQRASQGAPGTLAGAPSGAAVRRPAPA

SEQ ID NO: 29804 - protein, 106 aa, Pseudomonas aeruginosa
PRLIYPGFTLAAGTARAPRSPMCRFRNRQSSRIRRRGRNRTGGAMRRLLSLLILVLPLSACVVYDRNDHRHRPDYRYERYHDRDRDNRGRDWNRSWQERRDDARWR

SEQ ID NO: 29805 - protein, 695 aa, Pseudomonas aeruginosa
IAHADSASNVDLECIGIIAVPLGIVPAEAHNNKTEYPMSRLLALLALAPLLAGAAETTAPKPPSAFTVEAQRRVEAELPFADRADFERADRGLIRRPERLLIRNPDGSVAWQLGGYDFLLDGKPRDSINPSLQRQALLNLKYGLFEVAEGIYQVRGFDLANITFIRGDSGWIVVDTLTTPATARAAYELVSRELGERPIRTVIYSHAHADHFGGVRGLVEPQQVASGAVQIIAPAGFMEAAIKENVLAGNAMMRRATYQYGTQLPKGPQGQVDMAIGKGLARGPLSLLAPTRLIEGEGEDLVLDGVPFTFQNTPGTESPAEMNIWLPRQKALLMAENVVGTLHNLYTLRGAEVRDALGWSKYINQALHRFGRQAEVMFAVHNWPRWGNAEIVEVLEKQRDLYGYLHDQTLHLANQGVTIGQVHNRLRLPPSLDQEWYDRGYHGSVSHNARAVLNRYLGYYDGNPATLDPLSPEDSAGRYVEYMGGAERLLEQARASYARGEYRWVVEVVNRLVFAEPDNRAARELQADALEQLGYQAENAGWRNSYLSAAYELRHGVPRDQPTMKAGSADALAAMDTGLLFDYLGVRLDAGAAEGKALSINLRLPDIGENYLLELKNSHLNNLRGVQSEDAGQTVSIDRADLNRLLLKEVSAVRLVFEGKLKSSGNPLLLGQLFGMLGDFDFWFDIVTPAAKSEG

SEQ ID NO: 29806 - protein, 714 aa, Pseudomonas aeruginosa
RSRCRLPRRQYRRTPARLASPGRARGRRGGPFAPRSGRRSSIPATRVPGAMCASRPSSSRYRPSTCWLAGSMLMNTSAPCTASRALRAALAPAATRPSTALLHQVEDVQQVAGLEQVGGHRRAHVAEADEGDLFHGAPPVAAARPLGDAVKQLRRYGRGGPAPSFGRGRRGGSEPRQRMLALPGRLEVRLDHRLRDRFHLRPMPVRCVVAIDQPCAYPLGEVRMARAVQAHGVFQAEHLGQRQVARTLDLLPDQMRGHRAALGQGLRATRKQRVGVVAQRHQRLPGARQVRLVEQCVQARPAREQLGLRQFAAGLVFEGAKQAVKLHLGRLVPVHLHQAGEQGVLLVVEKEAVGQVEVESVAGVHLRRAQAEEQAEPAGQAGEEPAGADVWVQADADLRHRQAAGRGDDANPGTLHQPHAATHHIAVGPADEGFRVGMDAVVEAVFIGEGSVAPGPVPRRVARGRRPLACARRRRRKRPWRRCRATARRRCRRPRPRRRVSPPGSRSSAGTGRSDSFPHPGWQCRCGSHAGSGVLRKARSCRGSRLGRAVAQPAGFDGKAQQLRHLGSRFSRKALTPSRVSWASNRSTKRSRSSGSQVFGARSRAPWISGLMVRIATGLWRATLAASSRAAPRASPLSTTCSTRPMRRAVSASTRSLQRIIRLAQPSPTSQGSAWVPPAQGSRPTAASGRAICAWRSAMRMSQARAHSSPPPMA

SEQ ID NO: 29807 - protein, 325 aa, Pseudomonas aeruginosa
PAASRLWIDDLAQGMDDLGIQTTESRRREAFRTDLRLAPAQPGGAFHHAAPPASRPGPPSARPGLLPAGPRLLSGGAWPPHAAARAGRQPVDLLPGRTRLAGVCRRARRGRRRRPAGPAQGPGTCLRRRLAAALEHLLGTFRRRTGGGFPASAGQRPAPAPGHAATPAGGVRCAAGAASPGPQPAALHPCRAPVAGPAHLAGGASGAGQPEIRTGAGHRRGAGADARAPARQPQPRRAGGAVQAVALPFRQDLSRPDRPGADPGFHPDEDGPCLPPARRGRAGGAADRRAARLRRSLLLLAAVPQGGGHGAQSLPGAAPGLVLRA

SEQ ID NO: 29808 - protein, 287 aa, Pseudomonas aeruginosa
CCILPVGRDRQGSSMRKPLSLYHPWLYWLRVWQRRLWRHCRWRLGGRRYVRLPSIDERLPYRYIKHTSKLIRRLGDSDLALQRNKVVNLRLAVDCMNGVSIGPGEYFSFCRLVGRPSARRGFVEGMELSFGEARSGIGGGICQLSNLIHWMALHSPLRVVERANHSFDPFPDEGRILPFGSGAAIFYNFIDLVLHNPTADTFQLRFHIAAHQLEGELLCSAPRPVRYHVYERAQRFVRDGDAVLRLNEIWRDIREKGQAGTLLASECLYRNRVRVKYPVEEARLSRD

SEQ ID NO: 29809 - protein, 245 aa, Pseudomonas aeruginosa
KRPDDFFSTETGGSMTDNDDRIKLEASWKEALREEFDKPYMKQLGEFLRQEKAAGKVIFPPGPLIFNALNTTPLENVKVVIIGQDPYHGPGQAHGLCFSVQPGVPTPPSLQNIYKELNRDLNIPIPNNGYLQRWAEQGVLLLNTSLTVEQAKAGSHANAGWQPFTDRVIEVVNERCERLVFLLWGSHAQSKQKLIDPQRHLILKSAHPSPLSAYRGFLGNGHFSRTNKFLEQNGKTPIDWSLPDL

SEQ ID NO: 29810 - protein, 261 aa, Pseudomonas aeruginosa
DAKLSPGFQQSPVAEKPFTGGFSPVHFASCALIRWWRTVHAHPSGGRSSAARRKRGPGAQGRRLDGRPAAGRGGRRPGSGQRGVRPGDPRRRPAADGRLRGAGAPARARQDPAGADADCARRGEGPGARPQSRRRRLPGKAFRTVRAGGAGQGPAAPQRARWRTVAALRRPGLRPRHPALQPRRAAADPDLAGTGGAGSDDRPSGAGDEQGATGRPGLRPGRGGQRRRHRDLRPPPAQEAGRRRRAHSHLPRPRLPAGGAG

SEQ ID NO: 29811 - protein, 407 aa, Pseudomonas aeruginosa
SSGCWREACWKWKTMVREFPPPTASGSSSASTGAATAPAAAWGWRSSARSAGRTGRRSSSTRANWAACWCGCASRWSRAGLLQHAGGGFQGAGEVLVFLHVDGRLEAELGERRDLAPVQAGIGMLAAKVALQGGDLDQVGIVRARRVAGEVQVLARDLGDRRGEIPGLENALADQRMDALDHMAQADGVRQQLVVILGVGEDRQHADLVHQSGQGRLVRRQAGVVTGQHVADAGDLGALVPDFAHLAIDHVGGGLEHLLHGQAGGQVAGVVDAQPADRHLQVGDFLRAAQQRTVHHADDARGQRRVVADHLAQGLDADIRVFRRLTDLQGHLGQGRQHQFILIDGADQVLLDFVGKLAHGISFENAMAGARSTCTGHGNTGGPSADGEAQFTVSAGFRGRCPACKAD

SEQ ID NO: 29812 - protein, 135 aa, Pseudomonas aeruginosa
RRTPGRCLRAPGRAANRRAAPRGCARGAWQAPPRRVAPEPIARRGRRPGRRRAGRRGGRSCRSPPGCLSPGRAVPRWRRASLCGARLRSRRQGWPWRIRRISSGPPTGPRAARRPSPAAGRRPRAGCGSSIAGGP

SEQ ID NO: 29813 - protein, 93 aa, Pseudomonas aeruginosa
CRAFSRSPNMADETELKRLYWHSRRGMLELDVLLVPFVQEVYPGLDAEDQARFRKLLECEDQDMFGWFMQRGEPEDADLRRMVRMILDRVQPD

SEQ ID NO: 29814 - protein, 235 aa, Pseudomonas aeruginosa
CSVRWGRYGRGSSALVKQSTKLCSLCCEKPDTAANAKRGIAMSREALHETLSAVMDNEADELELRRVLAACGEDAELRSTWSRYQLARSVMHREPTLPKLDIAAAVSAALADEAAPPKAEKGPWRMVGRLAVAASVTLAVLAGVRLYNQNDALPQMAQQGTTPQIALPQVKGPAVLAGYSEEQGAPQVITNSSSSDTRWHEQRLPIYLRQHVQQSAVSGTESALPYARAASLENR

SEQ ID NO: 29815 - protein, 162 aa, Pseudomonas aeruginosa
SSLAAGGSASADFRAVRFGLSLSLPSNITGAVVDAYPKTLYGCDGGLAGLEPGDDGPGRTAGLHAFGRTGVAGGGEYQYAAEAAGSRHGARAAVYPRPRRAAADVPRLPRTQHPAGSAQSARPAARGAIAGFRLHHLQRRLHPHQQSRRGRCRRDPGAPVRP

SEQ ID NO: 29816 - protein, 281 aa, Pseudomonas aeruginosa
LRRSAAEPAGRSGRHQLADLHPFRRLHGPVLRHSDRCRAERRRPVEESRQGQSRLAGRGDPGSEQGSRRVLRPRQAVRRAGGATGGRRPGGQGWPAGGRCDPQPERPVDQRVRRPAAPGGQHEAGRQDQPGRDSQRPAQVPEHGGRQPSGRRRGNRLDGRSGRRAQQQPPGRDRRRPDRRAAQEPGYPGRRGDQGSPGRSGRGHRPASGRCHHPPGQQGGDLDQGLRRRGQGPAEEPFGFDAGAAPGTRQLHYLQAGRISRLAKKGRFPPPFFMPVNPLPA

SEQ ID NO: 29817 - protein, 600 aa, Pseudomonas aeruginosa
AVSDLSHIRNFSIIAHIDHGKSTLADRFIQMCGGLSDREMEAQVLDSMDLERERGITIKAHSVTLHYKAQDGKTYQLNFIDTPGHVDFTYEVSRSLAACEGALLVVDAGQGVEAQSVANCYTAIEQGLEVMPVLNKMDLPQAEPERVKEEIESIIGIDATDAVACSAKSGMGVLEVLERLVTAIPAPEGEIEAPLQALIIDSWFDNYLGVVSLVRVKNGRVKKGDKILVKSTGKVHQVDSVGVFTPKHTETVDLKAGEVGFIIAGIKDIHGAPVGDTLTLNNTPDVEVLPGFKRVKPQVYAGLFPVSSDDFEDFRDALQKLTLNDSSLQYEPESSEALGFGFRCGFLGMLHMEIIQERLEREYDLDLITTAPTVVFEIVQKNGEIIYVDNPSKLPDLASIQEMREPICRATILVPKDHLGNVITLCIEKRGVQRDMHFLSGQVQVVYDLPMNEVVLDFFDRLKSTSRGYASLDYSFDRFEPSNLVRLDVLINGEKVDALALIVHRDNAPYKGRQLVEKMKELIPRQMFDVAIQAAIGGQIIARSTVKALRKNVLAKCYGGDVSRKRKLLEKQKAGKKRMKQVGSVEIPQEAFLAVLKVDS

SEQ ID NO: 29818 - protein, 150 aa, Pseudomonas aeruginosa
SWWSARGRRRSSSATRASGSKASARTRARTWKYCSTPRSCSTSGSRSRAAGPTTSVPCARWATATSDRSRQPGASRAPFLSRPVDPPCPSPPPKPPTCCIAGRTRKPAPWWTSSPRWVACARSCAAPAARPAPWRGHSCRWKRSGAGAAN

SEQ ID NO: 29819 - protein, 254 aa, Pseudomonas aeruginosa
TVRSHPVTEATRILLGVNIDHVATLRQARGTRYPDPVKAALDAEEAGADGITVHLREDRRHIQERDVRVLKEVLQTRMNFEMGVTEEMLAFAEEIRPAHSCLVPERREELTTEGGLDVAGQEQRIRDAVRRLAAVGSEVSLFIDPDPRQIEASARVGAPAIELHTGRYADAEDPEEQARELQRVREGVALGRSLGLIVNAGHGLHYHNVEPVAAIDGINELNIGHAIVAHALFVGFRQAVAEMKALMLAAATKR

SEQ ID NO: 29820 - protein, 868 aa, Pseudomonas aeruginosa
  UNSURE (844): Identity of amino acid at the above locations are unknown.
PPASVARRSRPGPRWTMAAADGRGKRTCSAPRLEWKGRQHKPCWRPSAKVGAADGRTGRPSAAGSGREQHLGHVAVALGEMHGQPFPEIVGQLFEVAAVGFRQDQLEDLLPARGDHLLADPADGQDLAGQGQFAGHRHAFLRHLVARQGEQGAGHGDAGAGTVLGRGTFRHVQVDERLVEEGRVAAILLQVRADVAIGDLGGFLHHVAELAGELEATVQRVDAGRLDRQGGAAHAGPGQPGDHADPGKHLLAAEHRHAEVVLEVPGTDLHLRLGILQQFDHRLAHQLAELFLQLAHPGFPRIALDHRAQRGIADAQAALGYAGLFQLLGPQVALGDGQFFLGDVAGQADHFHPVEERSGDRVEGVGGADEQHLGQVQAQVQVVVEEFDVLLRVEGFQQRRGRVALVAGAELVDLVEHDHRVHHLDFLQCLHQLAGQGADVGAAVALDLRLVAHAADAETVERPAEALGDGFADAGLAHSRRADQEHDGAGDLALETTHGEELEDAILDVVEARVMLVEDLARMLEVELVLAVHAPGQGCGPVQVVAGDGVLGRAALEDRQLVQLFVDTLARLLGQHLAFQAGAEFVGVGALVVLGDAQLLLDDLQLFLEEEFALVFADLAVDLGGQFLLQARDFHFLAQQRQDLLHPLEDRHGVQHFLQFAAGRGGQGRGEVGEWRRVVGTEAVQVVLQFLAVQRIERQQLLDRVDQGHAVGLHFVTGIDRGLRIVHLHHERRTMALDPAPDTHPRQALGDELQLAALARGMVHPDQRAVLGQAVDVEVARVFRRIVHEEQGQRMVVGLGHQFEGFRPGFLVDDHRQHLRREERAVVDRDHVEGGRQGLAGQHXAGAGGLRVADVFGINVLVAHEAPD

SEQ ID NO: 29821 - protein, 279 aa, Pseudomonas aeruginosa
AVAVHVRHPPHPSARPVAHPRPRASPTGDVAGRARRIRGQRLWWGSLPDARLPGAGRGGPRVRRGGRQPHADHRPGRGQPDPGRPRPARAPVRGAALPDPGRRLPEPAQLRRRRTGPLRQRPAADPCPRRSADPRPAPAPVRRAAAPGGQRAARPGAPGRAYRAEPGAAHHGRRTGPGRLSQPEPFPRAVQGQRRPDPAPVPAQGPPRLRRAVAAGKPPASGADRRGMRILQPERADHGDAPLPGADAEVAAQGLSAIRHLRRITAGGYSPYRQESIYG

SEQ ID NO: 29822 - protein, 1301 aa, Pseudomonas aeruginosa
VEDTPGRPLRVSPRLPFCRRVSSSPSSTLLGVAGDSLPSGLAVITWEGNSLGRPSAPSVSPETIRQASASGVRGQSGREGKRPEEDIAGSMVMGRTFFRPKRTQALPGGRATGSDRRIYWDVILFLFVSVDPRSHSAWRRADVQRQCPHACRRRGTGKFRSQEFSAKTPESFARIAPLAATTFRYPLVPRAGGMGLTHTDPYSRATGCAAPPAQPAGGGAPGNGRLAGLLSITMAPQEEGVMFKASHVLQGEDQTRSAAEFFPVISANYAVDEEAYLGELLQLADPGPDGIEAIRRNARALIETVRSRDNAVDTLDALLRQYSLDTQEGLMLMCLAEALLRVPDAATADALIRDKLSAADWQRHLGQSDNVLVNFAAWGLVMTGKVVNIDERTDGRAPSVISRLVQRSGEPVIRAAMNPAMKLMGKQFVLGRTISEALKNGRPCREQGYTYSFDMLGEAALTAADAEKCLADYRQAIDTVGAEPQVGPGPRPSISIKLSAEHPRYEVAQRERVLSELFANVLELAVRARKLNVGITIDAEEADRLELSLELYEKLMRDPAIAGWGEFGLVIQAYSKRCLPVLVWLTLLGRELGARIPLRLVKGAYWDSEIKQCQVQGADGYPVYTRKEGTDTSYLACARYLLSEHTRGVIYPQFASHNAHTVTAILALADEARAAGGEERDFEFQRLHGMGDALYDTVIEKYRRNVRIYAPVGAHKDLLPYLVRRLLENGANSSFVHKLVDPRVPVETLIQHPVTQLRQFKTLANDRIPLPQAIFGAGRKNSQGINMNIQNQWNELELAYKPHLTRQWQAAPIVNGEKLSGPAHEVRCPYDLERLVGSVQYASAEQAGKALDVLQAAWPRWSATPVDERAGILERLADLLEAQRGELMALCTLEAGKSLQDGIDEIREAVDFCRYYAQQARQRLVREELRGPTGERNELFYEGRGIFACVSPWNFPLAIFLGQISAALVAGNTVLAKPAEQTSLIAARTVELMFEAGLPKDVIALLPGDGATLGGVFCRDARVAGVAFTGSTDTARIINRQLAEKPGAIATLIAETGGQNAMIVDSTALPEQVIKDAVQSAFTSAGQRCSALRVMYVQQDIAERVIELLKGAMAELKVGPTDVRVSDVGPVIDAEAKAGLEQHIAALKAAGKLIAETKVPGNLNGHFVAPVAFEISGIDELKKENFGPVLHVVRYAAQDLEKVVQAINATGFGLTMGVHSRNEETARRIEELARVGNLYINRNQIGAVVGVQPFGGHGLSGTGPKAGGPNYLLRFVSERTTSVNTTAVGGNASLLSLADAE

SEQ ID NO: 29823 - protein, 125 aa, Pseudomonas aeruginosa
KRPRRGTSQRAAKAGVVETVRLPTLRCGRSVSTLCEISSRAPCRLRNSRSPQSVRRTFRGRRWNSGTPSQASSERIWWETAVGVTASSSAAALKLDWRAADSKVRNAVSGREANIGISMGELNSP

SEQ ID NO: 29824 - protein, 415 aa, Pseudomonas aeruginosa
SSPGWPGSSKRCGIWPTIGRVSVPSRAAMLTTLAVSNYRTLRDLVMPLRRLNLITGANGAGKSNVYRALRLLADSARGEVIPSLAREGGLPSTLWAGPEDISRAMRSGAQPIEGSVRRQSVNLRLGFAGEDFGYCIDLGLPEPSQSKFGLDPVIKRECIWAGPFLRPANVLVDRRGPLLRARGGGGRWEVAAQHLATFDSMLGAAVDPRQVPELLGLRERIRSWRFYDHFRSDAEAPARCPQIGTHTPVLGADGADLAAALQTIREIGDAAALDEAVDDAFPGSRLHIDNPGGRFEVLIEQPGLLRPLRTAELSDGTLRYLLWIAALLSPRPPALLVLNEPETSLHPDLLPALGRLVGQAAQHSQVLVVSHAARLVATLEEHPECHSLGLEKDFGETRIQGLRELDRPAWYWPVR

SEQ ID NO: 29825 - protein, 477 aa, Pseudomonas aeruginosa
QNEVVPMSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIFTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPVSSYLALAFLVMVVVLMAFFEDTRIALYIGPPFILLLTVLYYAFNLAPKEPAGTGSVSRAAS

SEQ ID NO: 29826 - protein, 285 aa, Pseudomonas aeruginosa
ASRGWPASRGWPILFAFRPDASTMRNASIEQYDATPRAVVAMGTDYPDGYLLPRHRHRRAQLLYGASGVMQVRTGDAGWVVPPQRAVWIPPGVEHEVRMLGVSTRSLYIEPGSAMAMPAHCQVLAVSPLLRQLLLAAVDMPLEYDTEGRDGALATLLLHELAAAETLPLHVPLPPEPRWLALCEAFLVEPDIRASAERWAGLLHTSLRSFNRTFRRYTGLSFGAWKQRACVVQALARLAGGETVTAIALDCGYQSPAAFSTMFRRVLGQPPSAFQAGALRSPGGP

SEQ ID NO: 29827 - protein, 143 aa, Pseudomonas aeruginosa
ATTPKPRASRCGSRPASRRYSVTTLEPGASEVFTHGLRTRPRRSALRASRPAAITLRGLLVLVQLVIAAMITAPSGIRPSASSARARSRLPAMPFAASSLVATLACGLDGPAMLRTTLDRSNFSTRSYSASTRLSAQSPAVRA

SEQ ID NO: 29828 - protein, 439 aa, Pseudomonas aeruginosa
SRRVPGSGLRCALFMARTQSRGVRKRVARAVAQPTPAFRILGAATVRRARVRRAGRRGSALLQRHERALLDAGVLGARADDAVVGALFEDVGGPAAGPRADEDRREQLGRDAHEVIRRGVVEVGVGEQLLLLPHGLVDGLGNREQDLVADLVGELLRPTLDHFVAWVGILVDGMPEAHDLVLALEHLQQLGGGFLRRREAFDQFHRRLVGAAVQRAAQRADGAGDAGVEVGQGRGANPRGEGGCVELMLGVEDQRDVHHLHVQLAGLLAVEQGEEVPADGRLVAVAVDALAFVGEAVPVGHDRREGGEQAVGDVALLVEAQLRFQGAEDRGASAHHVHRVGVLGNPFENFLQRLRQVALALELLQVGVELLLVRQFAVEQQVGDFLEDRRRRQVADVVATVGQAGAFLADGGQGCLTGHLATQAGATQYFCFSHCSLLS

SEQ ID NO: 29829 - protein, 191 aa, Pseudomonas aeruginosa
STRDTSAEASSSVVNSGVAPNSVMLASTGTFTAAANSLYMASSVMASGKIMSAPASTQAQARSMAACRPSTASASVRAMITKESSLRASTAALMRSTISCCETISLFGLWPQRLAPTWSSICIAAAPNLIIDFTVRATLNAEEPKPVSTSTSSGRSQTSVIRRTSVSTSSRPLIPRSGRPREPAATPPPDR

SEQ ID NO: 29830 - protein, 543 aa, Pseudomonas aeruginosa
MALKPARLASRAWLALMVPTTCSGCSVATASRKRWPGVRDVWLITDLLDGGGSGGELRRLGFQLALDIAARRTDVAAHQQLGQFAVTVGDGVENAVVFGEGLARPVRRGRVLDAVHPHQLVELAAEHAGEGGVAAALDDPVVEVVVAFLLVIAAPGLERLVALVGIEHPTQLVDLGLAHALGGQSAGHAFQGLADLVELDQLGVAQRHHPRPDMRHPHQQAQAFQAVDRLAQRAAADAVGARQLRLGDLAARRDLAADDGALDLAEDVFRQGLAVVMGNLERGRVLGHGTGCPGRCVDNVCESYRLDCVGSIIRRLIVDNRLMHRWSMLSPPAAVPGESFVGIYDRYVLPRLIDFACGMGDVMKQRSLLVPRAHGRVLEIGLGTGLNLGFYDAAKVSAIVGVDPAAQMQALARERAAQIGIPVEMVALELGEIRAEAESFDTIVCTFTLCSIAAPLPALGEMRRVLKRGGELLFCEHGRAPDASVLAWQRRLTPWWKPLAGGCHLDRDMPALLREAGFRIDELEQGYLPGPRPMTYVYRGVAR

SEQ ID NO: 29831 - protein, 212 aa, Pseudomonas aeruginosa
CSAPRRGSAGGTAACPARRRRVAAGHRWSAPGRARRCGRSRGAGRRRAGPARADRGRSARPRPASWGSGWWASPPAPACRAARPAFPGARGPATARSCPAPCRRPARRRCRVRAGSASSSGLRAGRAAVRRAGLAAGSPDEPGNCVGGGRSRAGCRRLPRPAATRRDRPGAPRPVRPGAACAAVRGRPGRSRKAPPAPASGGRRAAPRAAAG

SEQ ID NO: 29832 - protein, 163 aa, Pseudomonas aeruginosa
PGRQPVGQPAARRLGAGRRRPQPAGPRPALRLARLATSASVEQARPATPERPGGGLMLLVFGLNLLAFTALCLAMNRHHKNLLGHEPSAPRVLLLRGVALLDLGLALAFSIHRQGVEIGIVFWSCLLMLAAGTLVLLLAWRPRWALPCAAGVPLLGGVLALLR

SEQ ID NO: 29833 - protein, 170 aa, Pseudomonas aeruginosa
RARRPSVPRGRSGPASMLVVVLSPGGMRHAHARQQHRRQRHSLPALPRCAGRHRLAVPDLWLPAQAGGARRGRTGAPRRVDLRQPERRQRYADARLERPRQRLRSADAARRRSRRQYPEPLPGGRRSRRPVPQRPGRRRRDRHRHQGRGLRRSRLHLPRSGGPRLELRQL

SEQ ID NO: 29834 - protein, 177 aa, Pseudomonas aeruginosa
PRAAARCGGRSLAHPHGGLAMTAVAQVVAKAEMLIRRPIAEVFEAFVDPAITARFWFSRGDARLEAGKRLRWHWDMYGVSQEIEVKDLQTNRRILIEWPNGDSNPSQVEWLFEELPGAGTFVSIRNSGFVGTPEEVIPRVVDATEGFTLVLAGLKACLEHGIALNLVADRFPRGLDG

SEQ ID NO: 29835 - protein, 292 aa, Pseudomonas aeruginosa
QRDHCQRQLHRQDHLAEDQQPRGAILAVEQGHQQHRQHCDATGQQAPRPGRQAQAEEALHDDLPGQGGGDRRVEAGREQRHGEQQRGEFQAEQWREQRVGLLDIDHLGVPVAVEHAGGDDQDRRVDQQRQGQRQAAVGHRPAQRLALAGKAARVGAALHQRGMQVEVVRHDGRADDADRQVQGSRVAEHPRARQEPLEHLAEFGTREQQLYREAGEDQCQQRHHEGLQRPLATSDQDQHQQRVAHAEQGAPGQRQAEQQIQGDGGADHLGQVAGDDRRFGRPATAGGRCSGE

SEQ ID NO: 29836 - protein, 419 aa, Pseudomonas aeruginosa
PGPAKASRRRHQWPPPGTSTGWARPGSAAWGAGVSFADMTKLLPDACRRCARLSRRAVARGLGERFRGQEGGSRSGRGRQLPVQVQQVAGDQVPVLLGGEVLGLAGAVFQRPGDERGLQAEGARGLEVVVVRRAEHHLLRRQVEQAAGAEVDLRVGLVVAEQVGAQQHVPGQPGVPRDVEHQRGVAVAQRGEPVVGLQRVHPGERVRPRPQAVPEASDALQQGLVQRQAELSGQGLETLPVQLVKVLPGRLAVAYPVHRRLVLLAPAVGQFHAGQGPAEFALQRLELLDQAGTPVHQGDEHIEQDRAHRASSAVAVIASVLLWQRGGQSAAAPGGDHKGYRRHQAERQPAGDEAVAEVLEQPQRRRRENDRQLVDGHRQAEGEAGFADRRGIRHIGHPGTVPAEAEEAQPGQYQAHPQR

SEQ ID NO: 29837 - protein, 327 aa, Pseudomonas aeruginosa
KRPTVEERATMIDLVMLKDFLVLCRIKSFSRAAQECHVSVSGLSRRIQTLEQWLGAPVFERHKHALELTEAGRQLQGVAQDAVRALDNLRQSIRERDEDAQRRIRFCAPHILSSVFFPHWIPRLQADFRSAKFSVDCDYLPQCLSRLRDGSVDYVVALLDEGEAVSRRLGIDSEAEFQRLELGHEQLVAVCAPDAAGQPLFNLDRLQTEALSFLGYSEECHLGWALEPLLRDSGLFLQRHHSSSQTEGLRFFAQSRLGVAWLPHTLVREDLASRRLVRAGGQRFDVPLRYTLIRRRLPLPGEAERLWTFLGELARPAPRYAVVGAAS

SEQ ID NO: 29838 - protein, 359 aa, Pseudomonas aeruginosa
RMNGCVRSNSSASVAVHCGGAISTNGWRSTRCAESPRGRLNGGRMRIARSSSAASTWSSRCSETPGITCGSMCGACSARRLSTSGSSPVCAVFTAPMRRRPRGLSPWPMPSNSARICSAVRTACLPTSFRCAARGVRLNNSTPTLRSSARICALTADCVSPTCSPAAAKEPRRATATRVRSSRIIQASKKVLLRRNIMRFPSKSARQIIPAHPQRNRAMSLMPFHLAIPVHDLPAARRFYGEVFGLSEGRSAEHWVDFDFFGHQLVIHQHPQTDSQRHAGSNPVDGHDVPVPHFGVVLAWDDWHALAERLQQRGTRFVIEPYIRFKGQVGEQATLFLFDPCGNALEFKSFRDMGQLFAK

SEQ ID NO: 29839 - protein, 130 aa, Pseudomonas aeruginosa
WNIPWGLYFVAWDIEYTDEFGDWWGSLSEDEQESLAVTVRLLEERGPSLGHPHSSGINGSRHGHMRELRTQHGGRPFRTLYAFDPRRSAILLIGGDKTGDDRWYELNVPIADRLYDEHLHQLREEGLIDG

SEQ ID NO: 29840 - protein, 321 aa, Pseudomonas aeruginosa
LPQVRCPDASSRSCPPISCCTRRDSRCVGERQHAERSEHRRLKRRAINRNRSMAIIHDADLADVLLSASSDDIRLLIDVITDNGNGRISLSSSVCRQLSAAKEGVVGEFERGMVAEELMRFGGNSLMNLFRGGSGVPYKELLSDVASHVGVSKESTGDCARMEMAIITKVFEQSIGRMSEEDKATFFESLGTSYRSGMGPVALAALIASLSASGMTSYGLAAMVASATMSSLVGRGVALAGGATLGRGLSVLTGPVGWAIAGIWTAFDLASPAYRVTLPCVIQIGHMRQKMLLKPECPGCRASVSPGSNFCGNCGTRLVDR

SEQ ID NO: 29841 - protein, 273 aa, Pseudomonas aeruginosa
SEADQSGRLPAGQGVAVVTSNDISNTRQLLERVSNDDLEPLVEYILKARTESLSKQVDFKRWHPEHRRYASAILDELRLFGGNSFANLWRKSGPSYTEVVRDVAGKLKVKGVGSMELIELEEAMVQSILRQALEKSSGEDRRELEEILREAGLDKTKMTALLNGSALSGLVVPAVARMILYRTSTVIVNSMAQQLLGHGLRSAVVAGGTFAGGRAVAALAGPVGWVIAGVWTAVDLAGPAYRVTIPCVLHIAMLRLKARAEAATDFMNGAFDG

SEQ ID NO: 29842 - protein, 356 aa, Pseudomonas aeruginosa
SGRLATVGRPRAGDTVDPSTLYAPLDRVAGAPGEHRPAAFDHCQGEQPLLAGEGAGRSCRVARTMGGCMIDSHSHTSYSKHATGTVDELVRASIAAGVTILTITDHAPFPVDTDNRLLASELDRYFADIERARKIYQGQITILCGLELDYMPGTDAFNRELLTRYPMDFVIGSIHYVEIPDETMVKVWELPRLAGQTFLDRYFANLEGLLDSGLFDAVGHADTLLRGVPEDIFLRRFEPLLAPLTRSGIAFELNASGLRKSSLDPATGREVQGLWSYPSRELVAQLIAHEVPFTVGSDTHDPSDAGCGIAELLTALRPLGLKRISYYERRRRIDVALDSLPLLGTPATLTEGLERP

SEQ ID NO: 29843 - protein, 243 aa, Pseudomonas aeruginosa
RWPRPPSPRASIGADGMATAQWDGLQAVFEDLGGYGALARQAAQGEGPLVGHLQRTNIQLAAIPVFTRKGIAETTVNDLLEAARVSRRTFYKYFAGKLEVLESIYHSAVQLLLARFGGLRSEAGSDEDWLRAMVSLFFDYHLAVGPIIRMMQEEALHAGSPLAAHRQRAHLKIIELWAERLGAQGAAHDALTYRVLIWAMEAASLELLNASDPLELPRVKRVLGDLLVGTLCPRTQAPTRLQG

SEQ ID NO: 29844 - protein, 321 aa, Pseudomonas aeruginosa
QQDGRRASMSATPYLLQPPLAVGFARLGFGSLSLESLRERYAAPSSGSRFIELDGFPLHYRDEGSRDKPVLVMIHGVVASLHTWDGWVKAMSPYFRIVRFDVPGFGLTGPGRDSRYSGERMVAILGQLLDFLKIDKASIAGNSLGGYIAWNFALAQPQRVERLVLIDPAGYQMRKVPWMIASAALPGSTLAMPLWMPRALIAQGIKEVYGEPGRIKPGVVDRYYDLSRRPGNRKGMMEIFRVLLKVNREELGTSGERIARIVAPTLLMWGERDRWISPKHVPLWQRDLPGIQVKTYPGVGHIPMEEIPEQTAADALRFLMA

SEQ ID NO: 29845 - protein, 341 aa, Pseudomonas aeruginosa
TAMKQPLNFTAELVPVAYAEALLDLVAEYGVSRQALFDAARVRPEVLDSPNGRLSFLDFNQLTYSAQALCGEPALGLVLGQRLNVSAHGILGYAVLSSANLGKAIQFALKYYRVLGLAYELELVLDDGRAELRAVESMPLGAASVFAAEGLMATLYSIACFLVGEPLQDVRVGFAYPPPAHARRYAEVFGVAAEFEQPWHWLSMPSEYLERPMALANPATVQMCEQQCEALLATLDVQEGLLTRVRRLLLARPGDFPDLEQAARELHTSGRSLRRHLSSLGTTYQQVLDDVRKRLALQYLTTTQLPLYEIALLLGFNDSSNFRRAFRKWTGKLPSDYREAP

SEQ ID NO: 29846 - protein, 175 aa, Pseudomonas aeruginosa
RTERRHRAGRRLWRIQRRTGRDPDPRDVRRRRRTGSRHAVPRLGSGRRHADRHHPRHRRRRRDRRRQPSAGRPAPELQGQGSRRARGQRRGNRPRPHPWRRRSPPLIGVHSPIDGLGRPPAELLSWYSERRLWAPFASCAMPGLFTPSLGMRRSQGSCPVRGLARCVAECARSTS

SEQ ID NO: 29847 - protein, 397 aa, Pseudomonas aeruginosa
MLSCRAWSCCSAPDTCPNLPFPLRSPSMSAPVEALFQPFRLGALELPTRVVMAPMTRNFSPGGVPNAKVVEYYRRRAAAGVGLIVSEGTTVGHKAANGYPNVPRFYGEDALAGWKQVVDAVHAEGGRIVPQLWHVGSVRRLGVEPDASVPGYGPMEKAKDGKVLVHGMSKADIQDVIAAFAQAARDAQAIGMDGVEIHGAHGYLIDQFFWEGSNQRDDEYGGSLANRSRFAVELVRAVRAAVGADFPIIFRFSQWKQQDYSARLVETPEGLREFLAPLVEAGVDIFHCSTRRFWIPEFEGSELNLAGWTRELTGKPTITVGNVGLDGSEFLQFFGKTDEVAQPASIDGLVERLDKGEFDLVAVGRALLVDPEWAVKVREGRIGDIKPFSREALASLV

SEQ ID NO: 29848 - protein, 177 aa, Pseudomonas aeruginosa
DGPGAGVPGRPAANWRLRRSRSCRPARRARRCAHGGCAGRRRPGRRRPPRGRRPGLRGPRCRRSPTGLGRGTGRPRRSGRPGFRRAGRRRTALRAGPVRGACAPARRPPVPGAASAADGRRRARGRCRRAGRGSSLPPAGRRAARRCPVRPGPSAGVVRDRAGRDGRVGCRPRGRAG

SEQ ID NO: 29849 - protein, 323 aa, Pseudomonas aeruginosa
CRQESDEMPDTLRHARVIILGSGPAGYSAAVYAARANLKPLLITGMQAGGQLTTTTEVDNWPGDPHGLTGPALMQRMQEHAERFETEIVFDHIHAVDLAGKPFTLRGDNGTYTCDALIVATGASARYLGLPSEQAFMGKGVSACATCDGFFYRNREVAVIGGGNTAVEEALYLANIASRVTLVHRRETFRAEKILQDKLQARVAEGKIVLKLNAEVDEVLGDTMGVTGVRLKTRDGGSEEIAVDGMFVAIGHTPNTSLFEGQLALKDGYLVVNGGREGNATATNVPGVFAAGDVADHVYRQAITSAGAGCMAALDVERYLDSL

SEQ ID NO: 29850 - protein, 249 aa, Pseudomonas aeruginosa
RDLPARPDRLDPVAGLPAGQPARPAGTRRADGGERLRRRWQQHAWRFRPAAGASPCQLRGEPAAAGRRAALRDRQRAEQPDRPVGATGARRPAVPVADAPGQHLRAVRLAAFCRLLRAVAGARLVAAAPRGAGLAAPAQSPAASCSANTSRSTFAPLRIRPTFSPFRRSRSCQAAASAATPAPSATLWVLVKHRRMAAPISLSLTRTRRSAPARIISSALGSGVLHAMPSARRVSTGWLIAVPASNDRA

SEQ ID NO: 29851 - protein, 175 aa, Pseudomonas aeruginosa
GSAAATAAGRGRPAGRRCARPAVAPSPCPGCRGSGRRSPAAGRGRRSPAATPAGRPTRPGRRTPGARPSGSAAALPAGRVRAPGSVRSLRGGSGRRPARPASVRAPRDPCCARPGRSIRRAGGRSSCAWASRRSAGCACRRLPAGWRRSWRFQPWWPASSICSGRTHSSNCASSR

SEQ ID NO: 29852 - protein, 143 aa, Pseudomonas aeruginosa
TITGLNTLSCRWPWLAAKEIVLSLPMTWQASIDSASHWVGLTLPGMIELPGSLAGSFTSAKPARGPEPSRRRSLAIFIRATARLFRAPERMTSGSWPARAANLFGAATKGRPDSAAISAAMASAKPFGALSPVPTAVPPWANW

SEQ ID NO: 29853 - protein, 188 aa, Pseudomonas aeruginosa
SSWATKAESSWPKVIGVASIRWVRPVLTRLACRADCSARPPESSAMAGSNCSCTALAAAMCMAVGKLSLELCARLTWSLGCTGDLPPRGLPASSLARPAITSLTFMLVWVPLPVCQTTSGKCSSWRPARTSSAACSISRATSGGSSPRWSLTRAAAFLISARAWITASGMRWPPMAKFSSERWVWAPQ

SEQ ID NO: 29854 - protein, 190 aa, Pseudomonas aeruginosa
ADFELRRRMSGPTDTSTQPQGFSMTRLRLIGSAVLLSLSSMAMADSASQAEQFLKLVHADKLTVPVYAQVQQMLAQRFAQAKAPESKKAVLERYQAKANAELDRAIGWDKIKPELIKLYTTNFTESELKDLNAFYQSPLGKKVLEKMPRLTAESAQLTQAKLQGAVEPVNKLMADMDKELGVAAPAQKKK

SEQ ID NO: 29855 - protein, 390 aa, Pseudomonas aeruginosa
GVEPGCGAGLADLPRREQARHTLRRRPSRRGAEPAPAALDYAPSAGLPPALSFPWRQRLALFVPVRPLRGRPPGGYIPMTSIVVAALYKFVTLDDYVALREPLLQTLLDNGVKGTLLLAEEGINGTVSGSREGIDALFAWLRSDPRLADIEHKESYCDEQPFYRTKVKLKKEIVTLGVPGVDPNKQVGQYVEAKDWNALISDPEVLLIDTRNDYEVAIGTFEGAVDPKTRSFREFPEYIKAHYDPARHKKVAMFCTGGIRCEKASSYMLGAGFEEVFHLKGGILKYLEEVPQEQSLWRGDCFVFDNRVTVRHDLSEGEYDQCHACRNPVSLEDRQSEHYVPGISCPHCWDSLSEKTRAGARERQKQIELARQRNQPHPLGRDPRQSTLEN

SEQ ID NO: 29856 - protein, 213 aa, Pseudomonas aeruginosa
TLAKARLLYVMDPMCSWCWGFAPVAEALSRQAVADGVAFHLVAGGLRAGHGAALDPNTRGYILGHWQTVQQTTGQPFRFDDALPEGFVYDTEPACRALVAARSLDEESAWPLVRAIQRAFYAEGRDVTQAAVLAGLAEAVGLPRIEFAAAFDSGEARDATAADFAWVQDLGIAGFPTLLAERNGQLALLTNGYQPLAELSPLLGRWLERGRHE

SEQ ID NO: 29857 - protein, 402 aa, Pseudomonas aeruginosa
RRAAFHGPPVARRLAGGVRLHRPDAGGDPSVAGGGAGVQRAPGEAVRAAVQGHRLPHPPASDRAPPAYRPGRIRNPRRRVDQRPPGHRPGYPGQVRRGNPQPLPGRLADAARHRRDPGLDALAAGLADPAVQPAGDLVHGAAGQARQASQEARERQHRALHPGAHRDPRGDPGSPRRQSPGLFPRPPRPPRPGGPRLRRGLAMEERRRRARQRPAVPVRHRRVPRRGDAHRAALGPVDRPDARGVQLPLVHDRSGRTAARPAIRLLRRWRRVAADQRVAGAGRRAALPAAARSVRRPHDRWHRGARAGFRLRRGQGPGAVGPEHRRRREGCPGRRQRRRQEHAGATAARPLQCAARQHPLRRGAPGGNRPGLRARTCRGGPPASGAVQRQRAGQPDHGPRTQ

SEQ ID NO: 29858 - protein, 215 aa, Pseudomonas aeruginosa
KTLSVPPGAGQVRQTATRLLLFARCPPPPASWLPAGKASGVLRRDLERPTGDAVRGDGDGARSLSASLNGRWNEAEPDSRQAPPARPGMALHRRGAAAGHAGGRQSLRPLRGAQLCRRRKPLVEGPEGCHLLPHPLCRLTRRRRLPPLRGGHRDPPRRPRDAPCPGPARPGHRGGPPGHPQGRQPCRRRYRDHLAVPQLPRLQLLRARHRAVAGG

SEQ ID NO: 29859 - protein, 683 aa, Pseudomonas aeruginosa
QVRHGTDRRRRQDARGHRRRAGQRRAGATVEDRDPRDQREGHAGGQGLQRRPWRGLAGLAQAAAGGQPDHRQRAHPPGVPADPAATDAAPGSGERPRCRARTGPDHPGLDRRRSDHRRHPGGHFLPQPGRRADDQLDAGQGPRPAPGVAVPDRRRKLAGGGHAADRADPQRRDRRRSRAFQAGSASRRQQRAGDPGGRADPPWRRDHRGGPGASRHDPRAPVHGAPVLAGDPRCVDRADQPPRVRVSPADSAGTPGAQQRAARPDVPRPGPVQAGQRHLRPRRRRRTAAPGLYPAATRLARGRHAGAAGRRRVRHPAGELSGGKSRGDRRPSAQDHPGPALHLERAAVQLHRQRWPGAPAAGYLDPRGGAALRRYGLLHGQGKGPQPGPGVPSGRRRTIDALRRDDLGPAHPPGAGGRPLQSLCPAHRAAGRRCGGGLARRTAAAPARRGRAPGAAAELHTRRRALRPDDADRSLGGGECLPHPCRARPGPSRRADRHLRHQPLRRDHRRRVVPAVPHRAVRPLPHSAADDLLRGHRNRGGCQPGQRHPLHQRAQGHRLSFLPGRFLRWHVVLHLPQAPAGGLPEDRWQLRQGHARGSHRSRHGPGDQPYRPRDGQTYHRRVRRDRRSHGSAARDRHRLCPGPGHRRAPAVQSPASGRRAGCPGPVAEPRTEPPVGDRGAKKE

SEQ ID NO: 29860 - protein, 350 aa, Pseudomonas aeruginosa
FRCYEAVAEKKRRETGVSEFFDRTGPLQEAGSYPQWAQQLIVDCQASKDRVSGHELYRRMRDAELSPALMRLYLIGGWPVVEQFPLYMSQNLLKTRFARHPGEDMARRWLMRNIRVELNHADYWLHWAEAHGVSLAEIQAQDVPAELHALSHWCWHTCASDSLPVAMAATNYAIEGVTGEWSALVCSNGVYENAFPKEGRKRAMKWLKLHAQYDDAHPWEALEIICTLAGTNPSAELRRQLRDAICKSYDYMYLFLERLHAAGGGAQRPASSRSARSSLARSGNPGVFRRDSAGPQGTRMIFSQVPSFTARYCSTPCSSGTSRSPSGSGRRPWSNSLPKASRKPAQASTP

SEQ ID NO: 29861 - protein, 139 aa, Pseudomonas aeruginosa
SSELIPTTEPPRRYRFNAGRRTWPSAGAAMIARRPKAASAGTAASSQKPVVSKITSAPPGKIPSTCAASSAGSPSSSAAMPCVSSAWRCSSRRIAPIASAPRALASASAALPTAPLAPITRSRVPALTWLRCRASQAVL

SEQ ID NO: 29862 - protein, 61 aa, Pseudomonas aeruginosa
SVSPSFAQPTARRHAPRMAPAVRLPPEPHGPVSPPTTINFHLREIIQWTANIRIRASSSAA

SEQ ID NO: 29863 - protein, 262 aa, Pseudomonas aeruginosa
RPGAARWISEPAGLRDGSAYGLGHRLAEAALAVALQAIGLGRGRDRSDLAGFQPASQARGVGEVGVFAEGVQHHQIDRTAVDRGAHHQAVACLVGEAGLGQLDVPGLVVDQVVGVAEAQGVVGVAEGHGLLRSGAPLTEQRILPAGHQQAGEVASGGDVVQRQPGRLDVAGVLHSQGVGLGVHRLDEGVLAARIVLREAGGGAVLRGHQGEQEHVPAADLAADPHPGKHPAHFAGLADGDRQYLVQRQFRVEHDHGGHQLGD

SEQ ID NO: 29864 - protein, 187 aa, Pseudomonas aeruginosa
SRRPGARRRCRRASGWRRRVAPATAARRRRAPVPPGARRTAHRRGRRRSSWWFPARPGAARRVSPSAGSGSGPGHPCRHRRRGPACPRADRCGRRRAGPGSGRPVRGRPWRNDSFAPLGGFRYLVGARRHDEIVAVQALDRVAPPGHGDFAPLGQQARMVAFGLGYLADGIGEGQGMLEVLEQVDLL

SEQ ID NO: 29865 - protein, 534 aa, Pseudomonas aeruginosa
KTGREPIRTTTPGHAMRIKVHCQNRVGILRDILNLLVDYGINVNRGEVGGDQGNAIYLLCPNMINLQLQSLRPKLEAVPGVFGVKRVGLMPSERRHLELNALLAALDFPVLSVDMGGQIVAANRAAAQLLGVRVDEVPGIPLSRYVEDLDLPELVRANKARINGLRVKVKGDVFLADIAPLQSEHDESEALAGAVLTLHRADRVGERIYHVRKQELRGFDSIFQSSRVMAAVVREARRMAPLDAPLLIEGETGTGKELLARACHLASPRGQSPFMALNCAGLPESMAETELFGYGPGAFEGARPEGKLGLLELTAGGTLFLDGVGEMSPRLQAKLLRFLQDGCFRRVGSDEEVYLDVRVICATQVDLSELCAKGEFRQDLYHRLNVLSLHIPPLRECLDGLAPLAEHFLDQASRQIGCGLPKLSAQALERLERYHWPGNVRQLENVLFQAVSLCEGGTVKAEHIRLPDYGAPQPLGDFSLEGDLDAIVGRFEKAVLERLFREHPSSRQLGKRLGVSHTTAANKLRQHGVGQSEG

SEQ ID NO: 29866 - protein, 611 aa, Pseudomonas aeruginosa
SCPTWPSTCSNCRARSEAGAAHADRPSRPPGAHRPRHRRQHRFLHPRAGHARRYLRRGSQGPRLRCAEDQPAPGRGRIRTQGRATYARVRRPLFHRRHATRGGGRATAPAGRGNPRGPGAAHRRRRADPLAVPARPRPEPDRTEQPAVGRVPRDNYKRALVMTDYTQQLAGFLAGLRYQDLPPAVLARMEELFLDWLGSALAGKGQHPIPLFERYAERMGPADGSAQILPSRRRSSPYFAALVNGAASHVVEQDDLHNSSVLHPAAVVFPAALAAAQDLGRSGAELILAAVAGYEAGIRIGEFLGRSHYRVFHTTATVGTLAAAVAVGKLMDFDRERFVDLLGSAGTQAAGLWEFLRDAADSKQLHTAKAAADGLLAAYLTADGLSGARHILEGEQGMAAGMSSDADPERLVDRLGSRWALLETSFKFHASCRHTHPAADALLALMQREGLDHSQIAAVTARVHQGAIDVLGRVVEPQTVHQAKFSMGTVLGLIAVYGKAGLGEFHRHALSDPRVAAFRERVEMRLDPEVDAAYPQRWLGRVEVLDRQGRRHTAAIDEPKGDPGNTLSRDELADKFRRLLAFSGAATDAEAEILIQRAWGLRQAPSVAPLI

SEQ ID NO: 29867 - protein, 423 aa, Pseudomonas aeruginosa
STEPAAPRLRRTRAGSPTHDTIPPTAPARRHHRGQPGARHRRAVLHPPTGRSRRAGDQDRTPRRRRFRPRLRRAGQRPVVALRLDQSFQAEPQPRSQAGRGAAVAGEAAGRRRRAGAEPRAGRRRAPGPVLRGVARALPATDRLRYLRLRRRRSLREEEGLRPADPERGRLPFGDRRRRAERDGQGRLFDRRYRRRHVRLQQHPFGPAAARAHRRGQPHRRVDAGEPGGVDGLPDVLRLPGRAAAAARRRFALDHLPLWAIPRRRRRHGDARPAERARVAGLLRQGPAPPGTGRRRTLLGELQALGQPRGAACADRRSLRRLAGRRGGGAPGTGADRQRPRQRHGRGLGAPAVTGAATLDLHRQPGRAPAGVVAAGQQQRLRSAHGCGAGAGRRQRRAACRTGLYRGRYPAPARDRNGMRRRT

SEQ ID NO: 29868 - protein, 1014 aa, Pseudomonas aeruginosa
AMANSPNAPAASGSSIPRKHNNNLRSRNVQDDGTGAVVRPGDRWLLPGECRAADRHQVLPRGRGKHAQRPGRAAVQETRRTAPGRPGRGRRLSQLVAVRRRQGNGGAAAGRRADAGAVPGQVRAVHAQGADLRPAVPLRRHPGGRPLPAQPAGARLADQHAGQGHPRPGLLAQRDEAALRQSPVAGAGRRARAEIPRAGVRRAQRAVPPAPRDLPEDVLRRGLPGLADRRGEWHREHLVELREPEGQRGTEVFHRVQPRLGGLHGDHQREVLEWPSGGHPRRTAADHGRGHRAGEPRGRAPQPRRPPAHPRQWRQRDPYPEPAAARRLAPGDAAGMAEIPRQCRCRSAPGRRSFQPSRLTRPAPPGRAGHRGERCDESTRARLEPLRGGRYRLPAGGDDAGDLPLCGDDQRLHPVLRPRRPPADTAGSAVLDGRRDPRGSPGYVLEQRADQGAVRLADLPRHRLRRTHRRPPRGGCPGAPGAASLAAPDRDTRLPLLPGLRRAVHGRQLRLGEDPVRRRHRRRGPRPLRHPPGLHRGGGAGRLRPGAAALPGNPRQPVARSPARAGPRRRGRRGLQTGRRRGRGEPSMTVLILFLLLFLFMFIGVPIAISLGLSGALTILLFSPDSVRSLAIKLFETSEAYTLLAIPFFLLSGAFMTTGGVARRLIDFANACVGHIRGGLAIAAVLACMLFAALSGSSPATVAAVGSIAVAGMVRSGYPRAFGAGIICNAGTLGILIPPSIVMVVYAAATETSVGKLFVAGVVPGLLLGVILMVVIYIVARVKKLPAQPRASFREWLAAARRAGWGLLLLVIILGGMYSGLFTPTEAAAVAAVYSAFVALFVYKDMRLRDCPKVLLESGRLSIMLMFIIANAMLFAHVLTTEQIPQQITEWVVQEGLTPIGFLLMVNVVLLVAGSFMEPSAIVLILAPIFFPIAMKLGIDPIHLGIVMVVNMEIGLVHPPVGLNLFVTSAVTGMPLGATIRAALPWLMILLLFLILVTYVPLISLWLPGLLGMS

SEQ ID NO: 29869 - protein, 482 aa, Pseudomonas aeruginosa
SHVCGIPVPRAPGSGGTDLHRRSHLQDDVPAVRRQPRRLLARAGPADRLDQAVREGQADLLRRPSRGHQVVRRRHPQRVAQLPRPSPRRPRRPGGDHLGRRRSRRPPGNHLPPAPRAGLQVRQRPARAGRAPRRRSDHLHADDPRGRGRHARLHPHRRDPLGGLRRLLPRGPGRTHHRLQVEGGDHRRRRRARRQAHSAEGQCRRRPDQPGNLQRAEDHRLQAYRCGDQVEPAPRRLVRRPDEGCRQHLRTQGNGRRGPAVHPLHLRLHRQAEGRAAYHRRLPGVRLADPRAGLRLPSGRSLLVHRRHRLGHRPHLHRLWPAGQRRHHHSVRGRAELPRRDPRGENHRQAQGQHPLHRADRDPRDDGRRQGGGGRCRRFQPASARFGGRADQPGSLAVVLRDRRPVALPDRRHLVADRDRRLPDDPAAGRPRDEAGLRGQAVLRRGTGTGGQPRQPDRGRRRGQPGDPRLLAGPGADPVRRP

SEQ ID NO: 29870 - protein, 243 aa, Pseudomonas aeruginosa
KPRNCESRGPIVIFDFSVIWDSLPLYFDGLLVTLKLLSISLLIGLLLAVPLALMRVSKQPLVNFPAWLYTYVIRGTPMLVQLFLIYYGLAQFDAVRESALWPWLSNASFCACLAFAINTSAYTAEILAGSLKATPHGEIEAAKAMGMSRLKMYRRILLPSALRRALPQYSNEVIMMLQTTSLASIVTLVDITGAARTVYSQYYLPFEAFITAGLFYLCLTFILVRLFKLAERRWLAYLAPRKS

SEQ ID NO: 29871 - protein, 340 aa, Pseudomonas aeruginosa
SSRLRLLEAEGRLRGTVQLVPVGNPVGLGQMIQALHQGRFEMSSGAQLQSRFPRPAGRGDRQRRRASRQRSGGQCRAGPPGPARGAGRPAAGDLGTGGHAARALSPRLRRRPGARPALRLRGRHPSLYPAATMAHLRLPGRTPGRRCRAARRGVRRRFLRRGLLGAVAAPVAPVSARRAAAGLPGDHRRTRRPGRHHRAAGRGQRRGDPGLPRRAGLRRGRMAGGARSLLRRLALRGHRIRPRPAYRRGEFPAPAGRMGGGGRTAVPGHRSPGRPCQHRVRRGFRRAFRHRTDALRAAGTLAGQGGRSSTDPSGTLAQRLISREHTHVQTGSPRPAQALR

SEQ ID NO: 29872 - protein, 247 aa, Pseudomonas aeruginosa
PRGAQGRLAGGESGRRDQHHRLERFRQEHLSALHKPAGTAARRQDPAQRRGAEAGAWPRRRAEGRRLPPVAAHALAPVDGVPAFQPVVAHECPGERHRGARACARRVEEGSHREGRALPGQGRRGAPQGRLPGAHERRRAAARGDRPGAGGGAGSDAVRRADLGARPRTGGRSAEGHAGPGAGRPHHGGGDPRDGFRPRGVEPVGVPAQGPGRGTRLPEGSPRQPAVGPPQAVPLRQPQVTFIAEAG

SEQ ID NO: 29873 - protein, 332 aa, Pseudomonas aeruginosa
AAPMTAQPQRIGFLLWPATRALTLSLAEEALRAARRLHPEVLYEPLFLLAEAPAEEEGWRLPGTAWNGRLEQCSRLFLVADEAPAAVSPALGLALKQLARSGAAIGALSAGIYPLAQLGLLDGYRAAVHWRWHDDFTERFPKVIATNHLFEWDRDRMTACGGMAVLDLLLALLSRDHGAELAGAVSEELVVERIREGNERQRIPLKNRLGSSHPKLTQAVLLMEANIEEPLTTDEIAQHVCVSRRQLERIFKQYLNRVPSQYYLELRLNRARQMLMQTSKSIIQIGLSCGFSSGPHFSSAYRNFFGVTPREDRNQRRGGSAFETTFTPVERG

SEQ ID NO: 29874 - protein, 435 aa, Pseudomonas aeruginosa
QVVAWRQCRPGPNPYNPFIDSRLQAGETPMSAPHAQVERADFDRYMVPNYAPAAFIPVRGEGSRVWDQSGRELIDFAGGIAVTSLGHAHPALVKALTEQAQRIWHVSNVFTNEPALRLARKLVDATFAERVFLANSGAEANEAAFKLARRYANDVYGPQKYEIIAASNSFHGRTLFTVNVGGQPKYSDGFGPKFEGITHVPYNDLEALKAAISDKTCAVVLEPIQGEGGVLPAQQAYLEGARKLCDEHNALLVFDEVQSGMGRVGELFAYMHYGVVPDILSSAKSLGGGFPIGAMLTTGEIAKHLSVGTHGTTYGGNPLASAVAEAALDVINTPEVLDGVKAKHERFKSRLQKIGQEYGIFDEIRGMGLLIGAALTDEWKGKARDVLNAAEKEAVMVLQASPDVVRFAPSLVIDDAEIDEGLERFERAVAKLVRG

SEQ ID NO: 29875 - protein, 343 aa, Pseudomonas aeruginosa
ERSDAMLVMRPAQAADLPQVQRLAADSPVGVTSLPDDAERLRDKILASEASFAAEVSYNGEESYFFVLEDSASGELVGCSAIVASAGFSEPFYSFRNETFVHASRSLSIHNKIHVLSLCHDLTGNSLLTSFYVQRDLVQSVYAELNSRGRLLFMASHPERFADAVVVEIVGYSDEQGESPFWNAVGRNFFDLNYIEAEKLSGLKSRTFLAELMPHYPIYVPLLPDAAQESMGQVHPRAQITFDILMREGFETDNYIDIFDGGPTLHARTSGIRSIAQSRVVPVKIGEAPKSGRPYLVTNGQLQDFRAVVLDLDWAPGKPVALSVEAAEALGVGEGASVRLVAV

SEQ ID NO: 29876 - protein, 141 aa, Pseudomonas aeruginosa
RSRPGSRPACRPACSTWSRAVAKPASRWPPTVGSTVCSSPGPVAPATCCTASLAASRRKSWRWRWAATTRWWWRRSPTSTPPSTPSSSPPSSPQASVAPAPAACWCRRAPGATHCWRAWWRSALPCGSVASTNSRRRSWAR

SEQ ID NO: 29877 - protein, 96 aa, Pseudomonas aeruginosa
SATPISLRRSVKPTPPSTAWPPGCCRIPASVSSSSSWKAAPASSTGTSSSPAPPAARRSAVSARPATTGRAPTTPPITAPIRSPRWKAPACPFLPP

SEQ ID NO: 29878 - protein, 335 aa, Pseudomonas aeruginosa
GHPMLALGKLLDLTLAGREPTEKIQLTADGTRLHWLAEGALEVTPIGARDNGVDLLLSAGIHGNETAPIELLERLIRKVAAGTLKPAARVLFLFGNPEAIRRGERYVEQDMNRLFNGRHEEGSGNEAFRAAELERLAQVFFSKTERVHLHYDLHTAIRGSKIEQFALYPWAEGRQHSRSELARLRDAGIEAVLLQNKPGITFSAYTYGQLGAEAFTLELGKARPFGENQEVNLERLERSLELLIDGSEEQPDGSRLDGLKLFSVSREVIKHSDHFRLHLDDDVANFTELSPGYLLAEDIGGTRWVVDEVGARIIFPNPRVKNGLRAGILVVPAKL

SEQ ID NO: 29879 - protein, 382 aa, Pseudomonas aeruginosa
GVSAFPLDHDGALRRSVSVAAGKISRLPLWLSVERRRIGLFRRTEEPSVPVIDLRSDTVTQPTAGMREAMAAAELGDDVYGEDPTVNRLEAELAARLGFAAALFVPTGTMSNLLGLMAHCERGDEYIVGQQAHTYKYEGGGAAVLGSIQPQPIDGEADGSLHLDKVAAAIKADDFHFARTRLLALENTMQGKVLPLDYLAAARAFTRARGLALHLDGARLYNAAVKLGVDASEITRHFDSVSVCLSKGLGAPVGSVLCGSVELIGKARRWRKMVGGGMRQAGLLAAAGLYALDHQVARLADDHANAARLGDGLRELGYAVEPVQTNMVYVDVGERAVALRDFLAEREVRISAAARLRLVTHLDVSAESIGQVLDAFAAFRRS

SEQ ID NO: 29880 - protein, 106 aa, Pseudomonas aeruginosa
PFGRNFHSGGTGQYWVKDRALDFCGSAAISFLQTVVLKYSREEKGMLILTRRVGETLMVGDDVTVTVLGVKGNQVRIGVNAPKEVAVHREEIYQRIQKEKDQEPNH

SEQ ID NO: 29881 - protein, 190 aa, Pseudomonas aeruginosa
CERPARWAGQGGNTMFQSTEQALAVAYWMFEHQPGPKSSTAMVIDGLRERFDRSFIEHLPSGLSPHEWQAQAVMTVRFAQRQLAAHPLELAVVRAEFARGRDFVLGLAALRDWLKPGADPIEQRATLALLMRMFRRPPSSIREIERLSGLSKSTLHRWDKEWRERVVALLRQALQRLEEPMAEVGIVGER

SEQ ID NO: 29882 - protein, 121 aa, Pseudomonas aeruginosa
PAASACSSGCVAANCPAGCAGCCAAGEASPMVDPLSTLTVLVCSAICMRLITYRRAGARFRPGVSLCAYLLALCTGCQALGIVAGLYRAEHLSPWMLGVLLVLLVLLLQARGNLARVLRLH

SEQ ID NO: 29883 - protein, 495 aa, Pseudomonas aeruginosa
PLWRAPLLGVERAMTEVEAKKPQESLQDRLAQVVELLHRHKVVEDLTHRQEGQHHDRVENLVHRQNLVELQRKLEELHPADIAHILESLPLDDRLTVWQLVKSEDDGDILLEVSDAVRETLIADMDDHEIIAATKDLDADELADLAPELPRDVVHELMESLDAQQRERVRSALSYEEDQVGALMDFEMVTIREDVSLEVVLRYLRRLKELPGHTDKLFVVDYDGVLKGVLPIKRLLVNDPDKQVLEVMATDPVTFHPDEDGYDAAQAFERYDLISAPVVDKGGKLIGRLTIDEMVDLIREESESEVLNMAGLREEEDIFASVWKSVRNRWAWLATNLITAFVASRVIGLFEGSIEKLVALAALMPIVAGIGGNSGNQTITMIVRAIALDQVQPTSNSRNRLLRKELGVALVNGLAWGGVIGVVAFYLYGNWELGVVMTAAMTLNLLLAAMMGVLIPMTLHRFGRDPAMGSSVMITAMTDSGGFFIFLGLATIFLM

SEQ ID NO: 29884 - protein, 473 aa, Pseudomonas aeruginosa
RRLRSTSLLSIVLSGTVGDEKAPRGGALQGGSDQLGPEVVLVGIGDAHADLVARLQLVAVDEHVAVDFRSVGPGAADRALFVDFVDQHFDFLAHLELQASGGNRLLVGHEAFPAVLLDLVRHRLQAQLVGRSAFDGGVLEAADAVELGFRQPVEQVLEVFFGFAREADDEGRADGQFRADLAPLLDPGQGLVLEGRALHGLEHLRAGVLEGDVEVRQELAGGHQRDHVVDVGVRVDVVQANPHAHAAQRLAEFLHAGLDRLAVPEVGLVLQVHAVGAGVLGNHQEFLDPGLDQALGLAQHVADRPADQLAAHGRDDAEAATVVAAFGNLQVGVVARGQLDALRRDQVDQRVVFGLRRHHFVHRGNHLLVLLRAGDRQHAWMHVADRVLFHAHAAGDDDLAVLGDGFADHFQGLGLGAVDETAGVDHHDVGVFVGRNDLIAFHAQLGEDALGVDQRLGASKTDEADFGSGGGHG

SEQ ID NO: 29885 - protein, 660 aa, Pseudomonas aeruginosa
QSVASALASRTAWAQHLPNFSGGKRFMSDAATRAEETSEGHSSSAIGLMVGAVGVCYGDIGTSPLYTLKEVFIGGYGVQANHDGVLGVLSLIFWSLVWVVSIKYVIFVLRADNQGEGGVMALSALARRAAAPFGRLQTFVVVAGLIGAALFYGDSMITPAISVLSAVEGLEIAFDGLEHWTVPLALIVLIGLFLIQKHGTARIGILFGPVMVLWFGALAALGVYGVIQQPEVLQAMNPVWAVRFFSSHPGIGVAILGATVLALTGAEALYADMGHFGRKPIARAWFLLVLPALVLNYFGQGATILSNAEAARNPFYLLAPGWALLPMVALSTLATVIASQAVISGAFSLTRQAIQLGYVPRMTIQHTSSHEQGQIYIGGVNWALMVGVVLLVLGFESSASLAAAYGVAVTGTMLITTLLMGVVIWRLWKWPLWLGVPFFCVMLAVDSLFFAANLPKVIQGGAFPVIAGIVIFILMSTWKRGRQLLVERLDEGSLPLSVFISSMRVQPPHRVQGTAVFLTARTDAVPHALLHNLLHNQVLHEQVVLLTVVNEDSPRVSPDRRFEVEAYGDGFFRVILHFGFMEEPDIPAALRLCHLNELDFSPMRTTYFLSRETVIPSKRIGMARWREGLFAFLLKNANGNLRYFNLPLNRVIELGTQVEI

SEQ ID NO: 29886 - protein, 412 aa, Pseudomonas aeruginosa
AGCNGNRVQPWSLQSAAHATTPSGPDPIAWRPVLPGVDVVQGGVGDRRQRLAGKEGLVGGHHHVGEAQQACQHVILQGLVGAILEEDIRFLFIDIEAEVAQLSALQRLDQRRGVHQGATAGIDQHRAGFHRRQALRVDEVAGVGGQRAMQADDVGLGEQGVERQVAAAECLDARIGIGIVGQQLAAEAGHDAGEGLADLSGADHSDAFAVEVEAGQPMQREIALAGPVVGAVQAPVERQDQADRVLGDSVRRIGRDVHHRQAERFGGGQVDVVVAGRAQGDQARAAGRQAFQHRPREVVVDEGADYFEALGEDRRVRLQVGLLEVQFEAVPVVAGLEALAVVGLGAEEQDAHGQSSLESRLVEDRWVVAEAVSARASMALSSSSRAAAAAGSFCLSRVSLVWQAARNCGTPQ

SEQ ID NO: 29887 - protein, 260 aa, Pseudomonas aeruginosa
SNSCSLRCSLRVQAGLASTCSSGRVAWYCACSVVGQSTRVLQPSRSNSQNDWLSSSGGWIAAETPSTARLIGNWPGGGLRRLSWRLSRSANSLTSRPKSVSWWCSERRVSSCGSSSATRWPAAQEAPGSSLSSRLFGRLRLIQNSAPSPGVLSTPISPPICSIRRLEITRPRPVPPACRDSELSAWLKALNKACWSSSERPIPVSCTLIRSCARSSLSSSSMARTATVPPWVNLMALPTRLVRICFSRCGSPCNWIGVSR

SEQ ID NO: 29888 - protein, 356 aa, Pseudomonas aeruginosa
TRLTSSSCFSWAAGASMVRASWIRSRRLKGRFSRTSLPASIFEKSRISLMIPSRLSADFWMVVRYSCWRGLSSLFCSRFVKPRMPLSGVRISWLMLARNSDLILLASRASLRARSSSMFWISMVSRFCRTSSVAWSMLCCISSWALCSVSAMRLMPEASSSSSLLPIGGRRVSMRPSLSWATPWLISSSGALIARLMRRARRAVTPRPAAISKRLVNRLRYPRSRVPWCDSSSSTQPSTRSSSGSVAPDRLWWRPRTGSRKCVVSSSVDMLRWLASPAGATVSMLGPAWARRSWRASRKVTARTSGWSSASLAMRLSTAVSFRASAVAASGASCSAISCPRSINWARMSDSWTQVK

SEQ ID NO: 29889 - protein, 484 aa, Pseudomonas aeruginosa
SQPGHARQSPAAQAATPRLRRSPVAYRLGQGLRPDTGAMMPNRHSLFWRLALVLVAFFLLSVWLSWTWGRSAELKGYYLSAEARSALADYARRAERAWLDDGREGIDRWLAEPRQRALDWVVVLDGRLQSLGSRPLTTEEAERLTFLRGVDWPMSSRSLSRPFISLRFPEHPEQGRVVLRLPAEFVPPGLSPAKRLVTHGLVPAGLALLLGVLLYRRWIVPLGRLRAQANALRGNDLTARTQAEISRRSDELGDLGRAFDHMAERLDEHMVLQRQLLRDLSHELRTPLARLQVAAEGTLSAQLLRERLEQEVQGMQQLVDNTLELAWMDTERPVLALEDISIPALWDLLVENARFESGWAAERFRSDLPEDCVVRGNLNALAQALENLLRNAIRHSPEGGVIRLHGRREGSCWWLCLEDQGEGVAEHQLETIFRPFTRLSSARTGKGFGLGLSIARRAVVLQGGRLWAEAADPGLRLCLVLPSA

SEQ ID NO: 29890 - protein, 371 aa, Pseudomonas aeruginosa
RGGAGHRRTGAQAGTGGIHHHRRGHQEAPAGERSLRDHPHHARGQPHRQQFQRPARQQPADRHPRHGAGEHPDPGRRQAGQLAQLGALRLARRTRHPRRQQLGAAGGGRAHRGPPWARGGTLRFRRGGRGSQHHHQAPDRSFAWFHDGVHQHSGKLQGWRHAPRQLQPQRAADRSLELPRVRQREQDRFGRYRHQPRTYRQPEPYRGRTRRGTQSRSQRDAVVAGDPRPGRRFRSGLQPTGQHLCRRYPEQQRHRQYPGTRRRGCGDQPHVSRELRHHPQRDLVVRHFQVRRPVRLHPQQPSGGGAGRFRRGADRRRPFVQHQQAGELSPQRRTQPSVACVVRAGADGGRGVEQGNPQRPVLAQAGLRGKR

SEQ ID NO: 29891 - protein, 246 aa, Pseudomonas aeruginosa
GPAPVSRYHAQPLPSVPNECLHDRAVPDYRRLRWQYPSGASAAPSRGNLQYPAGEARRQQPGGIGEGPPGPVDDHPCRTARRHPPRRYADRGYFRQHRHRPGHGGGDQGLQDDPDHAGQLHGRTQGGDDRLWRRAHSGQQGRGHGGRARSGRQAAARRPRQGPRPVRQWRQPGSPLPQHRPGNLAADRRQHHPFRQLHGHHRDHHGRLALPQGAEPGGADRRPATHGGLGHPGNPTLAAGIPAEDL

SEQ ID NO: 29892 - protein, 456 aa, Pseudomonas aeruginosa
PALSMSMARNKGGLRFQPSGGARGPAIPVGKKQRLTIERLAHDGRGIAHEAGMTWFVSGGLPGEELEARVLGARSKVVDARSERLFSSSDLRRREPCTVAGRCGGCTLQHLEHGEQLALKQRTLQEQLQRFAGIEPEEWAAPLVGPEFGYRRRARIAVRWDAMARRLDVGFRASASQEIVAFDECLVLVPPLQTIARALPALLQDFRKPESIGHVELFHGTASALLLRHTTALVDEDRQRLAAFCSAHQAQLWLQGAEQPLPVEPAAELGYSLGDWQLTLAYRPGDFVQVNAPVNESMIRQALDWLAPTADERVLDLFCGLGNFSLPLARRVARVVGVEGVAAMVERAGANALANGLGNAHFFQADLSKALAEAPWAEQGFTAVLLDPPRDGAFEAVREMSSLGARRVVYVSCNPATLARDAGEMARQGYRLKRAGILDMFPQTAHVEAMALFEAG

SEQ ID NO: 29893 - protein, 751 aa, Pseudomonas aeruginosa
RVGKMVQVRAHQPVNTDGSINLEAWLDHVQNLVPGLDRQGLLEACEFARESEQRAIAAQNSWAEGTSSFQTGLEIAEILADLKLDQESLVAAVIYRGVREGKITLEAVNKHFGPVVAKLIEGVLRMAAISASLNPRHSMVLGTQAQVENLRKMLVAMVDDVRVALIKLAERTCAIRAVKNADEEKRHRVAREVFDIYAPLAHRLGIGHIKWELEDLSFRYLEPDQYKQIAKLLHERRLDREQYIANVMSQLKEALAATGVQADLSGRAKHIYSIWRKMQRKGLDFSQIYDVRAVRVLVPEMRDCYTALGIVHTLWRHIPKEFDDYIANPKENGYRSLHTAVIGPEGKVLEVQIRTHSMHEEAELGVCAHWRYKGTDVKASSNHYEEKISWLRQVLEWHEELGDIGGLAEQLRVDIEPDRVYVFTPDGHAIDLPKGATPLDFAYRVHTEVGHNCRGAKINGRIVPLNYSLQTGEQVEIITGKHSGPSRDWLNSNLGYVTTSRARAKIVHWFKLQARDQNVAAGKALIERELSRLALPPVDFDRLAEKANVRTAEDMFAALGAGDLRLAHLVNYAQQLVEPDRDSEQLELIPRKPSKIGHGKRGDVQIQGVGNLLTQMAGCCQPLPGDPIVGYITLGRGVTIHRQDCATALQLAGREPERMIQVSWGPEPVRTYPVDIAIRAYDRSGLLRDVSQVLLNERINVLAVNTRSNKEDNTATMQLTIEIPGLDALGRLLARVSQLPNIIEARRNRTP

SEQ ID NO: 29894 - protein, 488 aa, Pseudomonas aeruginosa
RHGDCSTAPGCRDCSSEDLQDSFRRPANHRLVTCDQHRTLDQLRMPGHCLDDGLFAKTGLIQAEGLVFVLPGPQQLAGGNAELGQDRFQLGDARRGFQIAHHLRLQAAGFEQFERCAGFRAARIVQQDQFAHVRGRMAGEVTAILTASSTRTEPVGAKYRPERRRTGATSRRGHARTFQRWGRVRSLPRSSLRHRQGSQQRGGADLHHVVRGSADDDGDVFHAFADSGIPWHGRVDPDFHLSQFRAFRWRSGGNLPEEFHHPGPAPDLGRGGLSGSHRLHYAGDHRESLQRDLAGSPATPRCRAVPPLLGDPQPGPIVAGGRLRRDHLHHFAVAAPWPGRVAGRGDAAGADAAGVQRGGLHPALFGGPERPGPGAPCPDGRRVHRGTVRSRENPVRAVRKPVSRLPVDLRCLRHRAYLPAVDLSFLDDRSVRRGAGLQSLFFPSLAAALAAQADRPARRAEGVPPAPAAWTVAAPDPLASCGLAVARG

SEQ ID NO: 29895 - protein, 201 aa, Pseudomonas aeruginosa
EVSGLLLPIFVSTRFCRGGWLPVRSRHSAAPGCPGPADVFLTREVPDMGSWLRPLGAAAVLFLAGCSADYGVDQDGRPVAAEQLDGHWLVVNYWADWCAPCRTEIPEMNRLAQVLEGQGGRVIGVNFDGLRDAELKKSADGMGIRFTVLADDPAPRFKLPRSEALPVTYIVDARGEMRQRLLGEQTADGILKQLEALREGR

SEQ ID NO: 29896 - protein, 407 aa, Pseudomonas aeruginosa
WRGSACMPMSAAGYRASVSVRRPGKRLIASNSTVGCETWMTGVSKSSGRARRTGRKPWSDGWGGARGTRRSLRSRSSKCRCRGSLASSSVADEASSPSGRLARVRGQATGIPEQGMHELLLQFGVVARELDQALFQFAGFFFQAQLREAFHPMDPVVDVIAFQVVIDQGVSFQELAAQAAADAEAGIGAGTILWVAHRKVYLRDAADVLFGEGAVEQVEAQHAMTVGKQFVEFLAGTDQDRTLRPGQAGVFQALVALFLVDAREILFGATVGFHVHERIHPGQSVVDPAVGDVVRYAAEGHHVDDVRSDAGHQRHRAQRDLVDLPPGLVRRIAVVTARHLELGDLEGLLVVDPDPALRQFEHIGLADIDLQGVFEQLPLDALLMLATLRQLVGAAAQQKAAAQGGGE

SEQ ID NO: 29897 - protein, 209 aa, Pseudomonas aeruginosa
SSVWKTSRGWWARRGKTKRLLPIIECTKNPPFGGFSVFRGGQRREAITSSACRPLSRCTTENSTRWPSMRMRWPSPRIARKWTKMSSPESREMKPKPFEVLNHFTVPVSRLPLSWLPPRAAGALALRETGLPGFRLPASCRAVASTRLSRGRTIAGWSAMVGSGASRISACRTTPRTSRAAAPACSGRVGCDDCSTGAKSRLIRPRMAR

SEQ ID NO: 29898 - protein, 143 aa, Pseudomonas aeruginosa
WPLARASTRGVSQRPRGDPHPWPDGPEHRAGVHGAQRRFGPEAGAGAGGGHRRGNGGGVERGGVHRLAGQAGSRGDRRCRQAAGADDGHASVEADPETADRCFRRPGHRPVSCPYPTESGPPWPGGRTPTWRAPASLNKESSS

SEQ ID NO: 29899 - protein, 149 aa, Pseudomonas aeruginosa
SMRAQHGGKPFQQRFRVYYEDTDAGGIVYYVNYLKFMERARTERLRALGFAQSQLVGDNLLFVVHSAEARYHAPAKLDDELLVSAEVEELNRASLKFRQQVRRASDSVLLCEGRFLVACVRADTLKPRAIPETLRAAFAGSPDSFSAGD

SEQ ID NO: 29900 - protein, 438 aa, Pseudomonas aeruginosa
TGGFESVSTLIRIALFALALVAGAAQAADPLVISSGNDRAIPIAVVPFGFQGGNVLPEDMSNIIGNDLRNSGYFEPLPRQNMISQPAQASEVIFRDWKAVGVNYVMVGNIVPAGGRLQVQYALFDVGTEQQVLTGSVTGSTDQLRDMSHYIADQSFEKLTGIKGAFSTKMLYVTAERFSVDNTRYTLQRSDYDGARPVTLLQSREPIVSPRFSPDGRRIAYVSFEQKRPRIFIQYVDTGRREQITNFEGLNGAPAFSPDGNRLAFVLSRDGNPEIYVMDLGSRALRRLTNNLAIDTEPFWGKDGSTLYFTSDRGGKPQIYKMNVNSGAVDRVTFIGNYNANPKLSADEKTLVMVHRQQGYTNFQIAAQDLQRGNLRVLSNTTLDDSPTVAPNGTMLIYATRQQDRGVLMLVSINGRVRIPLPTAQGDVREPSWSPYLN

SEQ ID NO: 29901 - protein, 145 aa, Pseudomonas aeruginosa
GSFPGDRMSDPMPTPVFIKRTVLFGDCDPEGIVYTPRFSYFVLEAVQEALGVWLGGPGLRTLLGFRILPPARAFSLEFLHPVTWDDELTMQVGVSNVGTHSFSFSVEGRLSPDVVAFTASLTQVCVSPDTREVMEVPAQLRALLA

SEQ ID NO: 29902 - protein, 257 aa, Pseudomonas aeruginosa
ARRFWFLPAGCTTACVRPCSSPWPLRWTTTRSCWRSASTSISPNRFPRTCCPANCMCCRPCRATTTASWRAPSCATWPTPFITTTFRRNGHVDSGCGGEPAPILCVSGGAAGRRTPSRPGRRDADAALAAGGSRSPGRGGGQARGDRPDRRPRPVSRPSDREPRHHGAEDRPSVAEGPRRESRACLRPHRLEPGPRPLRGRYPRQRPGLSQRPGRARRIQPGIGSGQRVRLRPCRRRPGAALPADRQGRVPSRCAGR

SEQ ID NO: 29903 - protein, 451 aa, Pseudomonas aeruginosa
RRHPALALPPGRVACGRVATPAWPVQPGGAAPRARNAGRRGGARAAGRLVQLRPGRAVRTLAGAGRTCAALPGLPVPGAGVAAGHRSPGAPDFAAGVRPRSGRARPVGRQPAPVCRRIPWRRGGGFRVAGGRRTGRQLPGRPGRCELCPPGRAPAGPREGRRRVPDRTVAQLQHAVCGPLAGLSPVVPAQPQPVPLLPRCGGLLPVRRFAGVGIEVRRGESRGGTLSHRRHPPARTRCPGRHRCGTGQSPGSGVAPGRQGDRRAHDAGRPGAQRSGAGLPQRYAAGARHAQGRSLQPRDAPGLARGWRTAWRTGCAACLPCLPEHGHPGRCAEGPCHAVAAAVRGWLSRQLRWRDRHSRQRRQPRYQHRHPLRRGPRRYRPGPGRRRRGAGFGSTAGGRGNPQQGAGGADRRGRCRTRKGRARCASRCWITSIPSPTTWSSSSACSARRSG

SEQ ID NO: 29904 - protein, 218 aa, Pseudomonas aeruginosa
CATIRRCRRSRRYCWPTVANCWCCRRGPVGRKTPAACWNCSPGPAGACRCSASASATRRWRWPPVARWARRGSRCTARARPCVSISVTRCSTASLTCASRATTRWWSVACRKVSTAWPMPMARSWRWPIRAIDSWACSSIPSRFSPPTASVCWRTLYSGAARWRYASAFGPERRCAVSTMLGCQAGASSKRWRPSSRRRWRALSRKRRKLRSDSSAVL

SEQ ID NO: 29905 - protein, 80 aa, Pseudomonas aeruginosa
WTTASPSSGRPDHHLGRYIQRENGADMLLWDGACIFHEEFNAKPAGRHEGALPGRRHSWSTPNRRKAWSRWPMPWARPAS

SEQ ID NO: 29906 - protein, 208 aa, Pseudomonas aeruginosa
TLLSTKSLSCGSEIASTWLRSMLSQARPSWNSCSGETIEEDASPREGRSSDMTGEASMQASVNRAGRSTFMQEAQVGKGLTLAVGYRHCLGICPSPRSCWTSSAVSTGQRRIGLGMLVGPSGEAVMTDNDSSPLVCDAELDASGLNCPLPLLKAKLELNRLPSGGVLKVIATDAGSQRDFRAFAQLAGHELLREEAAEGVYRYWLRKR

SEQ ID NO: 29907 - protein, 368 aa, Pseudomonas aeruginosa
RSLRRSDSGFPMIKVLRDWMQRYFSDEEAVVLAIMLVLGFSVILAFGGMLAPVLAAMVIAFLIQGVVGMLERFRVPHLFAVWLVYSLFLGLLALFLVVLLPLLWQQLFTLFNELPRMLGEWQSVLLMLPERYPSLISEEQVLKAIETARGEFGQIGQWALTSSLASLPVVVNVMIYLVLVPILVFFFLKDKKRFQTWFHRYLPRERGLMKQVWAEMNQQIANYIRGKVIEIVITGAVTYIAFAYLGLNYAALLALLVGLSVVVPYIGAVVVSVPVAMIAFFQWGWSDQFIYLMVAHAIIQALDGNVLVPLLFSEAVNLHPVAIICAVLLFGGLWGFWGVFFAIPLATLVKAVLDAWPKDLPETPAATR

SEQ ID NO: 29908 - protein, 210 aa, Pseudomonas aeruginosa
IGHAGRGRAHPGDPSRGRPGQGPHPGDRRHRRQLHPRGGGADRGREKRRRRRLPAGDAVLQQADPGRHVPALPPYRRSRCDPADPLQRTGPHLLRHASGDRRAPVQGAEHHRHQGGHRRPATRQGSHRARRQGLPRLFRRRRHGRRADAAGWQGQHLRDRQRRAARHERPVRRRHARRRRSRARHQRSPDAAAQGAVHRIQPHSGEVGPA

SEQ ID NO: 29909 - protein, 437 aa, Pseudomonas aeruginosa
DGSDPRGHPPAPDLAQPALPRAAASGHAPDRRIGLIKELHAMKRLAGLTALALVIGNTSGCGWLWGPEGYFRDRGDDYLGARETPPMQLPEGVHSKPLDPLLPIPLNVATTHEKEGEYEVPRPQPLANAGDISDYSLQRSGDSRWVVAQRPPAEVWPVARQFFEENGFRIADERPQTGEFSSDWQSLSQLSAPLARRLSSRVSGVEPDGQARVRVRIEPGVQSNTSEVYVLSQTRAAGDTSSPSWPSKSVAPSLDAALLDEMVASMARSAEQGGSVSLLAANSIYDTPGTFELSKDGSGNPVLTLQSDFDRSWVSVGRALDNADIRVDDLNRSLGVYYVNIAEGAKKPDEDKPGFFSRLFGGGEKTKEEEDAKAQRYQVRLTTVSDAVQVTVDKDINTSAPADVAQNVLEKLQESMRNAVRGSGQRKPGQFGLGEQF

SEQ ID NO: 29910 - protein, 413 aa, Pseudomonas aeruginosa
KNAKKSSRKLRVLRTSWYHARRTERCRSGRTGRIRNPLSQQWLLGFKSLSLRHIQGLQRFSLLGPFSFGGILGELLRVTFPHSPTKVRRMAYFEKRGSAWRAQIRRKGHPTLSATFDTKAEAQRWAAEIEGDMSRSRFVDTRAAMRTTLGKALEQYEREISEHKKGASQERGRIRRWLAHPLAAKGLGEITPSDLAEYRDSRLKDGASSSTVRLDLAIISHLYTIATKEWRLEGLTNPCKNLRMPKGSRARERRPTTLELRKIYAEAAKLHPELPVIIELAADTAMRRSELLLLRREQIRDKVAVLEDTKNGERRMVPLSSRARELLKSLPARIDGKVFSLAPNTVSNYFPKACEAAGVSGLTFHDLRHEATSRLFERGFSMMEVAAITGHKTLVMLKRYTHLSPHALADKLG

SEQ ID NO: 29911 - protein, 420 aa, Pseudomonas aeruginosa
SLCLRLMGCRLERPLSSPRSRTGKKHQNGRKTSQPLLAGRGGEQFEFLRVLVAATLDNVRLAHRLAVAELAAQRFEQEVGHLIDHLLPAYRYRVALAIGVAILEAELLRHAVLAPGRCGGEHVAQFPEQSFPGSAALCEEFTQAPDEPLRHAVLSHDLFVGDLRQDDQGTSEFVGREALEVAQDALEVLVEVVGVYPVAIAVGRQLRDPGQGGLQLILQALGIAANALHGPAAIDGILRQPFADAFELAQALDFGQGGVALLLQLRDTSRQIAVERLLRVSVAPCLGEVAGHHAHHAVFEGVGTVLSGLQLRPQLPDDALVLGAQFIQAIADDERGFGNVLHVAECAATGFVRAGRLICSLPNLLGVVAARIEVSHLRPLRLCLCLRRGGLRQGGAGLLRGYEPAGAVAFAADFSDITVA

SEQ ID NO: 29912 - protein, 72 aa, Pseudomonas aeruginosa
TMETWVMHRIPLKEFSAQKGQTKAAALLGLTQGALNKALRVGRDIYVTENADGTYSAEEVKAFPSHSAKAVA

SEQ ID NO: 29913 - protein, 284 aa, Pseudomonas aeruginosa
VEAQIQQSPERLLQGFVGAQASCSWLARIAIRGDLSMSYRESIRKSVRFEVFKRDNFTCQYCGAKAPDVVLHVDHINPVSKGGDNEIINLVTACLPCNLGKSDRLLSDTSMLDRQRAQLEDLNERREQLEMMLAWRDELQSFGEETVQLIADRITARMVGHSVNEHGKTVIRKWIKKFSVEEILDALDIAADKLSTAPDQEEVLECFDAIPRICVTRRLPEAKQKMLYARGILRRRIYVNEAHVMPLMAKAIEAGLEVEELIEFAKQVKNWTEFRAEMEEIANG

SEQ ID NO: 29914 - protein, 174 aa, Pseudomonas aeruginosa
REDRAVTPAKQESLMQGQTGIAKKVYECVPISEPWRSFQVLTALRNMTGSTPDVRIVQGCLRDLVDSGLIRRTGTDHYQRIQVEKKTKHQEPKMAEPAKKIETQSEPKRSASPLEMLGELANELAGMAEHMKRLSDRIEDVALAVEQERESSAKSMESYRQLKALLKSLQGEGE

SEQ ID NO: 29915 - protein, 70 aa, Pseudomonas aeruginosa
AEGCVMSEKTHYCSFCGESEHDLKALIKGPSALICDACVALCVDLLEDKGHWPPAACSSEVPGAKPEEVE

SEQ ID NO: 29916 - protein, 196 aa, Pseudomonas aeruginosa
AVAELALIRTAQGLVPATEADRETVQKWKAGQVVHGKFTRMRNAKFHGKFFAMLDLAWEYWEPKGGLVPRQEMRGIRGLAKYFEDLNGRPGQLQNAVAAYIAKLEADRADRFPAVEKSREAFREWITIEAGHFHLIHTPDGVRKEAKSISWASMDDTAFEPLYRDVFAACWRLVLSSHFETEADAMAAADQMGTFA

SEQ ID NO: 29917 - protein, 269 aa, Pseudomonas aeruginosa
FGQLGGCSMKETGSTYLNGISCPCAATSSPSSRRRRRWRHEQVHHLHSRYDLFVAHHWSDCIGSLVRLGCADLGVRMSLSTRQLKPKICQNTECGTKFIPQRLGQRVCSPACALATKDKHQAPARKAIADRNRREIKARKEKLKSRSDHLREAQQAFNEFIRLRDADQPCISCGRHHDGQYHAGHYRTVAASPELRFEPLNVHKQCAPCNNHKSGDIVNYRINLVRKIGAEKVEWLEGPHEPLKLTIEDIKALKAKFRAWVRELKRATA

SEQ ID NO: 29918 - protein, 93 aa, Pseudomonas aeruginosa
PFGNTARGAMMSTFMGSARETQIAAVRVRRGWFGKLVVQLRYKIERPESPLPGRELIYHVCGLSRWRDANANDFAESLMVAKLIGMSDEGTPS

SEQ ID NO: 29919 - protein, 154 aa, Pseudomonas aeruginosa
RFSSLCCAPDCWRSILMNGKAESSRSSDRHKLGGKAGPRRFRQPAIRYPEVPDLPQRHTKPKANGVTKHEVEDKAWGNGRGGRPWRRKRERILRRDGYMCQCPECKGVKRIATEVDHIIPLSQGGTDDDSNLMAIAGYPCHARKTARESAVSRK

SEQ ID NO: 29920 - protein, 586 aa, Pseudomonas aeruginosa
RRPTARSSAWKSRRRRTSSRISEMTPSDIARQYASDVVSGGIVACRYVKLACQRLLNDLDRQGDDDWPYVFDEAKADRAVKFMQLMPHTRGKWSASKSKLVFEPWQVFIEANIFGWVKRDTGKRRFREAYEEIPRKNGKSARLAARGIYLFAADGESGAEVYSGATTEKQAFEVFRPAWMMAHKLENLRNRFGIELSGNQKNPGPMFVMEDMSKFETVIGNPGDGASPHAALVDEYHEHDTDALVDTMQTGMGAREQPLLSIITTAGSNLGGPCYEKRRDVIRILEGQTIDETIFGIIYTIDEDDPWDDPASLIKANPNYGVSVFPDFLLAQLQQAKRSASKQNAFRTKHLNQWVGARTVWMNMLAWQRQKRDFTIADMAGCRCWMALDLASKKDVAALVMLFEKAGQFYCIPRFYAPEAAAEENEKYQNFALEGHLILTPGSMTDYAFIEADILDLAKQVDLQDVAFDDWQANYLITRLSNTSIPVVDFNQTVKNMSDPMKEVEARVIARTLWHDGNPVMTWMMGNVAAKIDAKENIYPRKENDNDPNCKIDGPVTLIMAMGRALVAGVDDGDDFMNAIRNPIIA

SEQ ID NO: 29921 - protein, 421 aa, Pseudomonas aeruginosa
PVSKSLGKVLSSATSAPRSSLFGWGDKTIRLTDGAFWSQFLGRESSSGKKVTVDKAMKLSAVWACVRLISTSVAGLPLGVYERKADGSRVDARSFPLYDVVHNSPNDDMTAFQFWQAMVASMLLWGNAYAEIRRAAGRPAALDFLLPSRVDLECDDNGRLKYFYTPKKGARREIERTNMLHIPAFTLDGRIGLSAIRYGVDVFGSVMSAEDAANGTFKNGLLPTVAFKVDRILQPAQREEFREYVKSVSGAMNSGRSPVLEQGITPETIGINPVDAQLLETREHGVIEICRWFGVPPWMIGQTDKGSNWGTGLEQQMLAFLTFSISSITNQIQQCVNKRLLTAPERIRYYAEFSLEGFLKADSAGRAAWYSTMAQNGFMTRNEGRRKENLPELPGGDILTVQSNLVPLDQLGGAAKKSSPP

SEQ ID NO: 29922 - protein, 106 aa, Pseudomonas aeruginosa
MSLIPLDTAKSFLDVIHEWDDAKLQLLLDGAEDEACQFMWRQSLDGLCNCEESSEVVSSEPGIPPSVVIGVLLLLQASYQAAPDEIATLRKAAEVKLMPYRCGLGV

SEQ ID NO: 29923 - protein, 216 aa, Pseudomonas aeruginosa
NSTLVTKGSPIMTHALPPGLTDCLLWSEELGMGFHPRPPMDYTGPYFEKYQLLDATPMGAALTRARLDLVRRHFAGQVVDIGIGGGRFVTESGAMGFDVNPEAVDWLKAQERYYDPYQHHAEAVTCWDSLEHIPEPEKLLDHVGEWLFVSMPIYKDQADCLSSKHYKPGEHIWYHTMHGLIGWCERQGFECVELNDQESKLGREGITSFAFRRVHG

SEQ ID NO: 29924 - protein, 132 aa, Pseudomonas aeruginosa
WRNRQGSKGEVMHPPIFKVCSSSPAVTAILGASPLRMYQFGLAPQLVVKPYATWQTISGSPENYLWGRPDADGFTLQVDIFSATAAEARDAAKAIRDAIELSAYVVRWGGESVDPDTKTYRVSFDIDWIVQR

SEQ ID NO: 29925 - protein, 188 aa, Pseudomonas aeruginosa
TPKPISPPPRGFLLPATGEDVMSMLTQGTQVYALVPPRSGSGPFTVMEIECATSFNPGGNPADQIEDPCLSETSRKYKKGMRTPGQATLGLNADPRNASHVRLFQLSEDDSDQDIVFAVGWSDGVGVSPSADQDSNGDWDFDLPPTRTWFVFRGYVSDFPFDFAANTLVATQATIQRSGAGQWIPKTA

SEQ ID NO: 29926 - protein, 119 aa, Pseudomonas aeruginosa
GADMKLADLVAAGAVLGDGLVKKSITWTHTPPGKKKAVTDTFDVFIKRSSFGAMERLFAQDDDKKSQNARYLAESVRLGEGGEEEIPYETAFNLDPALGFLLLQAVAEVNGTGPGDEKN

SEQ ID NO: 29927 - protein, 1129 aa, Pseudomonas aeruginosa
MASRSLGVLTLDLIARIGGFQQSMNRASQDTARSMARIEQSTQRASSTAVSAIKSIGVAAAAYLSARELVGYSQAWVSIENRIKQVSESQAQFSQSMDAVYSVAQNAQSSLEGTAELYQRIAASTGDLGVNQQQVVQVTQNISKAMSASGVSAAAAEGALVQLGQAFASGVLRGQELNSVLEQAPGLAQAVANGLGVAVGDLRKLGEQGKLTSKQVFEAILSQTRAIDDQFARAQTTIAGAFQVLENSATRAIGSLDSTLGVSKAFTEAMVSLSKSLDSTNVQSFVQVLNTGLYLAIGRTAGALVGATAAKIADVKVTQEQTYAASVAAAGEVRRAQAVKAEAVAELDRARQAVASARAQVAADRERQASEISRLRAVQASLVAERELEGQRLKAQITEIGRQQSVARMAELRLAETAIIKQLQAAEAQLTATTVAGSQAVTAALAQRVSATEALSAANLQLTAAQTASTAAMGRWFAASTALGAGLNALRTAGAGILRIASGWVGLIISLGMVALSFVDFGDKAESNAGRAANAFEDASTRIRQAARTMIPEDLSGLSYDQLKQQLAGLQDQLKDAEALQERFQKGVDDNTDVPFGPSLDEAKEKAESLRLAIQKTQRELDGARFASDKAGASYLDNLQKQSVVAGKLTEVEKLRAQINAGILKLSPDDEKRALAYAAAVDKANASTKSQKDLLKDSAKGLKQAEERYRDLKKEIDPTATAADEYRKNIEALNTLKDRGKITSQEYAKGIEWAAKSFNSAVDAANPFVKRLREIKSAMDESLGNLKLEGQREILGMGMSDSQRGLFDKLNEENDRYAKARRDLADRYADRSVGMSDDEYQQELQAQQKHHEQMLEQLQANYDARLEAQGDWVSGARSAWETYVEDAQNYSKQASDFVSGALGDATNGLGDAITDIVTRTKSLGDAFGDMAADLAKSVIKALADMAAQWLVYQAVQLFVGKTAQSTAAIGLVDNAQAMAFQAQLAAFASTAAIPIVGPGLAAGAAAAAAAATAPMVAGVSSAAFGGIAHGGIDNIPKESTWLLDAGERVLSPNQNRDLTAFLSREGGASAGAGQAPSITINAPVTVNAQPGMSQEEARMQGEAAGLALREEVRGVIREELGQNGLLWRR

SEQ ID NO: 29928 - protein, 115 aa, Pseudomonas aeruginosa
VAETFSYCTRLGASGEIAQRTWQNDFGDGYVQSGGTGINTRSEIWDGMTIIGRLEAGDDLLGARAFLDRHEGYRSFLWTPPGGAQGRYRCNGYKLRPLGGGLYELSFTFVQVFYP

SEQ ID NO: 29929 - protein, 213 aa, Pseudomonas aeruginosa
NLRLVHGQQGPADPSPQGLPPMKTVRLHGALRREFGREYVLDVSGPREATIALASMVDGFEKFMRTAEERGMRFAVFVGRRNLREEELDLAGAGESVIRIVPVIQGSKSSGIFQTVLGAALVVAGYFTFGTTSAIGVAMMAGGAGLALGGVAQMLAPSTQASAAKNEDGNNPSYGFGGAMTTIAQGNPYPVLYGEREIGGAVESGGVYTEDQL

SEQ ID NO: 29930 - protein, 96 aa, Pseudomonas aeruginosa
CMSYGMRTRSAGGSILFDSNNYSLRMVYRRDLGNIPQGLSVTVPGFDGSKGVMFVVCNTPDSRSWIPRHTISGSTITFGWSGDVTANYTLYAVMFS

SEQ ID NO: 29931 - protein, 93 aa, Pseudomonas aeruginosa
TAADRCRWTCGVTAMIDWSKVKTAEQQAQERRQAEYDAAAVARANAYRLESDPLKTEAEFAAIKAGTEPDYSAWAAKVEEIKARYPLPETGGV

SEQ ID NO: 29932 - protein, 175 aa, Pseudomonas aeruginosa
SEVVYAHHRAATAAYPPERRPSSRRFCWCAEPRDDALRYHVACARGGVPRPSRPRKRPVDPLGGEPQLQCPWPGCDLAEPVPRRRRPAQRPGAAPGAQPPSHRQQRLRLAQRQWRRGIGRRLAVPRARAATDHRPVELPRRRHRGWASRWSRNPNCSSSRSGRRSRRPGGGPVTA

SEQ ID NO: 29933 - protein, 92 aa, Pseudomonas aeruginosa
SGVGSMRMVLMLVVFALAGCAGRQEAEPRTVRVEVPVAVPCRAPAVEVPAWAAAGLKKSDDLQTKVRALLAERLQRIGYEAQLLAANRACQD

SEQ ID NO: 29934 - protein, 360 aa, Pseudomonas aeruginosa
SVASEARRSCSARVAGRGPTSRRWHGCCRISRGSPGRRESACARWTSTRSSPCGRARAPGRWMRCWKSTRWPMALDPEVLLNYPIPEVRQRYSRRDSAFYALTLGLGGDPLDERQLAYVDPCRDLQALPCMALVLGHPGFWLGNPATGVDALRLVHGEQRLEWRRPLPAEGEVIGRTRVTGLVDKGADKGALLYSEKVLSDALSGEVLAVARSTTFLRGDGGFGGSRQVPETPHRLPERTPDLRLDLPTRPEQALYYRLNGDDNPLHAEPAAALRAGFPRPILHGLCTLGVAFHAVLRGLADYRAGQLGHLQVRFSAPVFPGETLRTEMWSDGSFRTRVVERDVVVLDNGRVGPPPERPD

SEQ ID NO: 29935 - protein, 463 aa, Pseudomonas aeruginosa
RSTEILLARTRIMNATALSPNPAPAISRRTMLIAFVFCFLGLLADGVDLMFLAYSLNSLKAEFGLSNFEAGSLGSLTLAGMAVGGIYGGWCCDRFGRVRVVTWTIVLFSIGTALLGLTQNYWQFALIRFVASLGLGSLFVACNILMSECVGTRYRTTILAAMQAGWTVGYLVATLLAGQIIPEFGWRALFFTAVAPALVCLALRPWVPESPSWLAAQAGRQRPGAAPQSHAEAGGAGPLGRMLGDPETRGMFLLWSLTSCFLLFGYYGTNNWMPSYLESELGMNFKSMTGYMVGTYSAMILGKVAAGVCADLFGRRLTFAAGAIGSAAFMPLIVFYHSPSNILWILITFGFIYGVPVGVLATYMTESFSTRVRGSAVGTAYNLGRIGAAVAPAGIGLLATHVSIGAGFLVMGITYVLTGLIPALFIADRLYDPNRESRDAESASRRQAPGSAVDTAERRAAKA

SEQ ID NO: 29936 - protein, 267 aa, Pseudomonas aeruginosa
PARPSSCTAASATPTRRTSACSCAAPWYCSMPTARWRSTRRATPRCYSGRWPDERFVAGNARHGAPAALRQPGPAQRTVAGAAHGIAAGPGGGRMRPIDPQRAADRWRRGVLRRRRPGRHAGDRVGRRQGANAGQRAAGAADGAHGQAADRRGRGLGGGGRAVRGAGLRQHRLRRRRPLRRRLRQGRAARRPRPVAYLAGAHRLGAGTADPDVRPGGTGRGGTAHRPGRPPLRRWRRLGDGAGAGRAGGAAGAVAPGDDQGVARRGP

SEQ ID NO: 29937 - protein, 130 aa, Pseudomonas aeruginosa
STDRRPGPPWARRPTGSSCWSAPSAAPRRSTASASCWCRWTARASRCGRSSTWSCTASSAKCFSTTCGCPMTAWSAESTRVGAWPRRCSVSSGSSSVRPSSPPSLSSAWSAWPGTWDCGTTLCSCAASPR

SEQ ID NO: 29938 - protein, 389 aa, Pseudomonas aeruginosa
RSSSPNCSSASASWAWRSPGRIRPCCSPSPKTPSCIRRGSSSSRGRPPSTAAATKSSATSWPRASSACRAERNRTTSTGRRGLPMSSRLNEGKVAIVTGAGGGIGREIALALADSGARVVINDIGVSLQGEGGSASPAEETLGLIRQRGGEGLINTDSVADWDSARRIVECAMDGFGRLDIVVNNAGILRDAIFHKMSADDWLSVINVHLNGSFFVSRAAAERFRTQQAGAFVHMTSTSGLIGNFGQANYSAAKLGIVALSKSIALDMQRYNVRSNCIAPFAWSRMTDSIPAATPEQKARVDKLQRMTPEKNAPLAVYLASDAAREVTGQVFAARHHELFLMSQSRPLRSVHSEHGWTPESIAEHGMPALRGSFMDLARSPDVFSWDPI

SEQ ID NO: 29939 - protein, 126 aa, Pseudomonas aeruginosa
PRRQSMGVFRTRFTETFGVEHPIMQGGMQWVGRAEMAAAVANAGGLATLSALTQPSPEALAAEIARCRELTDRPFGVNLTLLPTQKPVPYAEYRAALLETGIPRPPKPPATTPASTSPNSVDTASR

SEQ ID NO: 29940 - protein, 552 aa, Pseudomonas aeruginosa
AGAGRRRRAWYGKHGGSRQLGASMKTRNDVANKGRLLLPGKPTKTSGNEQPGEPHMIDGLLRSLGLDPNAFRDGELAVHTPIDGSRLAAVRLEGRAAVAAKVERAEQAFRAWRQVPAPRRGELVRLFGEELRRHKAELGELVSWEAGKITQEGLGEVQEMIDICDFAVGLSRQLYGLTIASERPGHHMRETWHPLGVVGVISAFNFPVAVWSWNTALALVCGNSVVWKPSEKTPLTALACQALFERAARAFGSDAPAHLSQLLIGDREAGEALVDDRRVALVSATGSTRMGREVAPRVAARFARCILELGGNNAMILAPSADLDLAVRGILFGAVGTAGQRCTTLRRLIAHESVKDEIVERLKAAYSRVRIGHPLEGNLVGPLIDERSYLAMQDALARAREQGGRVFGGERQLQERYPDAYYVSPAIVEMPGQTEVVRTETFAPILYVVGYRDFDEALRLNNEVPQGLSSCIFTTDLREAELFQGAAGSDCGIANVNIGTSGAEIGGAFGGEKETGGGRESGSDAWKAYMRRQTNTVNYSRELPLAQGITFD

SEQ ID NO: 29941 - protein, 437 aa, Pseudomonas aeruginosa
GGRHERSHQGTSQRRCRPGQGRPGRARAIGADAARTGRHRRRRSQRHQPLEDPGPAGGQQDRRAGSAAGASLSRTVCPVRRAAGGHAPLPAHSQPSPGGRAAGTDGTGAGPGSCAGIPRCDPRQGLIPGAPVRGPTPVTEKAGSQRRQAWLNGDCGAATLASDTTGSEGRKVSEIWRQCKGERHIRPLPGAPGAVGGEPGAGGDPAIGRHPGRTGVARGTARVEQAAGAGGCRAIALPVEDPVPLSALALGVAVWPSPRAKPVLRRAEAGNGHGRKRVLPLRPVEWHGGAATEREDSVRARFVRGGLEGGAGNPSAGAAFLRSRGCADRHRRIPRSPGTGKCHAQRRGAGIRIPFGALPGARLQCRPVHARGLHRKASSQPDALAVRNHGRLRGLQAGACAGVAENLLLGAVPGGRKVAASGVSGGGLGCQRSGGTV

SEQ ID NO: 29942 - protein, 178 aa, Pseudomonas aeruginosa
  UNSURE (116): Identity of amino acid at the above locations are unknown.
NPECGRASARPPGECRAAPRSLAVARVLLVELAQQRRPGELAAHAGLAAHHPGDHVARAGEDLPRDVDQLGAAALRHHLYLAGALQGEHHEEGIGDGTAAGEQAVVGQDQEVAGPXVGLQAGLFLMVQGDALVGVVGQAGKHEQRLLRQRQQALLLAGHRDPRGGMGVQHALDVVAEL

SEQ ID NO: 29943 - protein, 326 aa, Pseudomonas aeruginosa
  UNSURE (9): Identity of amino acid at the above locations are unknown.
GKGPPAGRXGDQQLPDPAQPRPAHLRRFHRRYLPHDVHPATRLRGTGDGAERRRRADPHPGADPRRRARHDRRGDAQQDRHGRPARLAGAAAQARPAEPGLPPVTAALPGIPLEAWRRRGRTRDFKGFPIRNWEAGQGRPLLLIHGFPSAAWDWQYLWEPLAQRYRVLVCDLLGFGDSAKPRAHRYSLLEQADLQQALLGRLGIDEPLHVLAHDYGDSVAQELLARHHEGRLRLASCVFLNGGLFPETHRPVLSQDGDENLVSHLNGGAGGSWIRPCKNAASDGDQLLSDFLSPRRPWEAQSGAIGDSDCMGTSGFGAPVERGQES

SEQ ID NO: 29944 - protein, 157 aa, Pseudomonas aeruginosa
  UNSURE (63): Identity of amino acid at the above locations are unknown.
EFRHDVECVLHTHTAAGIAVSCQKQGLLPLSQQSLFVLSSLSYHAYEGVALNHEEKARLQADXGTSNFLILPNHGLLTCGGSIADTFLMMFTLQRACEVQVMAQSGGAELIHIPGQILAGARDMIAGVMRSKTGMGGQLAWPALLRKLDQQNPGYRQ

SEQ ID NO: 29945 - protein, 121 aa, Pseudomonas aeruginosa
STVFPAPPGTGNTSGSRWRSATACWSATCSASAIRPSRAPIDTACWSRPTCNRRCSAAWESTSRCTCWPTTTATASPRNCSPAITKAGCGSPPACSSMVGCSRKRTARCSARTATKTWSAT

SEQ ID NO: 29946 - protein, 202 aa, Pseudomonas aeruginosa
CAARPAWAASSPGRRCCASSTSRTRATASDRGAARHSPGGLAEARPHSGFQGLPDPQLGSRAGSPVAADPRFSQRRLGLAIPLGAAGAALPRAGLRPARLRRFGQAARPSIQPAGAGRPATGAARPPGNRRAAARAGPRLRRQRRPGTARPPSRRPAAARLLRVPQWWAVPGNAPPGAQPGRRRKPGQPPERRRRRQLDQTV

SEQ ID NO: 29947 - protein, 462 aa, Pseudomonas aeruginosa
ARRPNRNALPCCDDRPRPPAGSAPCAASGLAPGCSGAAGSGPRCAVRPCRAGRSAGGGRRSRGRWAVAPGGAGGNAPGPVRPRGAAVSSRLLLRPVGYRYRSSDILWPAAFTGRLSELVGAGSDFCSGSAAFFRLCAAQDEAADRLDQLPGQRQVRVVVGGKLLETGARGDPQDVVHAVDEHQLRVGLGSLERLGVGDADLDVIAALDDQGRDAQAAERAGRVFAEQRDQVRLHAGAEQVGERRRDIAAGLPGLQRSQHRVGLAQLRRRQATAQLLAQHPVDGLAAAGDGDQFLGRRARRRQAGDQRAFAMADQDQPGEARVAGQPLAPGDHVVDIGADAEVFLAWRRRQAAGDSPLVVAHAGDSAFGQGLGETQQVAVVAAEGVVAVAVGGTGAGDQQDHRRRHGAARQQQGAAQHAVPGVQVVGAVQDAVGSGVGQAGEQAEQGEEGARHGGLHGPMIAL

SEQ ID NO: 29948 - protein, 427 aa, Pseudomonas aeruginosa
WPSSCSTNCCASVGRTPTCASTRRSCRSCEGCGRQRCGTGERRIVTSAVPYWRLSSFYFFYFSLLGATAPFLALYFHHLGFPSPRIGELVAIPMLMGCVAPNLWGWLGDRSGQRLTIVRFGAVCTALGFSLIFVSHSYAWLALVMALHAFFWHAVLPQFEVITLAHLRERSASYSRIRLWGSIGFICTVVGLGALFERLSLDVYPATLLGIMLGIVLCSWWVPNAQPAHREPREGEGGFLAQLRQPGVLAFYLCVCLMQLSHGPYYTFLTLHLESLGYSRALIGLLWALGVVAEVMLFLAMPRLLQRFSLCQVLAASFLLASLRWLLLGNLADSLALLVFAQTLHAATFGSFHAAAIHFVQRSFGPRQQGQGQALYAALAGTGGALGALYSGYSWNSLGPAWTFAIASLAALLAAAIISTRLQEVRA

SEQ ID NO: 29949 - protein, 432 aa, Pseudomonas aeruginosa
ADEQPYRLSREPAGAAAEAADPCRGHRFDPGRGRRPFRTLGSRRADRRRRQPGRGDRRLRPRDRAAQARARLHHRGRGQLEQRPPAEGRIARQVPRRAPPWRRRGALLRRRARPVRPAYRGACLRRALRAQRPYLGAGRHPPLVRHGRAPAFRRRAPVQQPGGLGRPVHRRRHRQPLPPAGRLSEAPSHPSPSAPPVLPGAVSSGVRMTIKAILTDIEGTTSAVSFVFDVLFPYAARHLPDFVREHAGETEVAAQLAAVRAESGEADADVERAIAILLQWIAEDRKATPLKALQGMVWAQGYRDGQLKGHVYPDAVQALREWKARGLDLYVYSSGSIQAQKLIFGCSEAGDLGPLFSGYFDTTSGPKRESASYARIAGAIGLPAAEILFLSDVVQELDAARDAGMRTLGLAREGGSLDGHPTVASFADILVE

SEQ ID NO: 29950 - protein, 73 aa, Pseudomonas aeruginosa
GNTLAREHRAMGSTLSGLISLVILALDIWAIVNILKSAAETGMKIIWVLVIIVLPVLGLIIWAIAGPRGNVRL

SEQ ID NO: 29951 - protein, 287 aa, Pseudomonas aeruginosa
PPAAALAACGVVVPQVDRGVGAPRPPGLGAGLQAARIDALRPPDRGFQQAEVGGGEGVGFAHGTQGYVFGGPGADAGQRAEALHQGLGAVRQVQAQLSRGDRRGEALQRLYPLAGHADAVEVGLRQRGGRREQVADAVVTEIFQRLAEALDQAPGDGHRGLHRDLLADDGAHRLFEGIEGHRQAQSRIGGHQRAEQGIPGEMPGDGGRVAVQVEHPADPCLEFGGQGMGGRAEAQRQDLAFRQRSHLEPGRATVGPEAAGIVVVTQAFDTGEQAQGEMLVELAPFPG

SEQ ID NO: 29952 - protein, 286 aa, Pseudomonas aeruginosa
GAHRAPAPGDFRKRPDGPGDGARWSDPDHRGRRVHLPRDAHPRADPRPRRGPARADHRRRRRWHAARGGQAQERRADHHGRDRRHRGRHVQGVPAQPLPGRLRRPAAEPGDRRRHALRGYHGRTLRRDHLRLHRPDRPWRGAVLRELLPGLPALPERGWHPGHPERHAVHATGGSAHHRRTYRRAVRRLAFLPGGGADLYRRRHDLRLGFDPRRPASPSAGNAAPALPRQRHRHPLLQRRYPPGRVCSAAVRAAGHRQAGQRLTLHQEGPQGPFSCVAPTSPVTAS

SEQ ID NO: 29953 - protein, 133 aa, Pseudomonas aeruginosa
PWSRRPRSASPKNRANIWNAPLYDNVALETTRQMLLTPNDKLVDADEAAVRREFTPPAANTLPIRNVVVVLLESFPRPYFWAPGGPRATSPRISKNGSRNACCFTSSSPTAPIPTRACSPPWPASPTCRASNT

SEQ ID NO: 29954 - protein, 317 aa, Pseudomonas aeruginosa
YKPRRAATSSPACRNCSTPRQYQDVYVYNGDFAWDNQSGFFSNQGMTTFIGRNDYVDPVFSDPTWGVSDQDMFARGNEELDKLASTGKPFYALLQSLSNHVPYALPKDLPVERVTGYGSLDEHLTAMRYSDWALGQFFEKAKKSPYYKDTLFVVVGDHGFGSPEQLTEMDLHRFNVPLLLIAPGIQEKFGTHLPTVGTQVDIVPTIMGLLGGETVHQCWGRDLLNLPEGDKGFGVIKPSGSEQNVAIVSGNRILVRPKDGDVRVYDYQLGGDAKAVITKEVPDQAELQKNLESFIQTATKSLLENTAGVVHGIPDKD

SEQ ID NO: 29955 - protein, 371 aa, Pseudomonas aeruginosa
RSGRIRLLAFQPAQDFGGGLDQVRRYVLVDIAVAQQRPCQRNSLQHRDSFFLGDAPDPQGQGVGVLQGDQRQGRFAASIAYADGDVGRVGDDHRGAPDIRAQVARLQFLMELPALALDLRTALHLLVLALHLVLAHAQLLVVLVAFEGVVGDGNRQEADRADQHQLPEHQPAHRCHAVQPAGGNPQEAGQVALQGQPDQQGEQGDLQGRLEELHQAPDREDLLRALHRVDLLQVRLDAVEAEQETVLADMAEHHHQRRDQQDRRQQVEELLEKVLQDGLQRLAKRQVDVLGGQQEQLAEMLQVVVGKAHQQRHQRQDQRAGDNFLALHHLALPAGVAQLLRRGLLGLLGAHGVSSTGRSRRSGSTASSRAS

SEQ ID NO: 29956 - protein, 346 aa, Pseudomonas aeruginosa
SGGCRRCSWSASVADDQAVGQPRPAVEEDEQEQLERQGNGHRRHHHHAHRQEDVGDDQVDGDEGQVDQEADLEGTGQFADCEGRQQDQQAVRVEPLGVFAGPDLAGAFHEEGVFALLDLPLEEVPVGRHALVEKAFHRCRVAQADVVVAQVVAGGEADRCHHVQAEDDRQPVHRHVRRNLLDAQGVAQQREDHGHLDEGGRHHRDERDQREQGQAEDQAELVGQLDHASSCPNRRVTRTPSRSWSLTSSPIPRQRWLARMRTSPSRALSRSSSEPGCRVERVCRSRVRRPTSKLTGIGSWSSSCRSSPSAREGVSCMSSSSSCVEWSWQRAQGRPSRTPSSAASGR

SEQ ID NO: 29957 - protein, 160 aa, Pseudomonas aeruginosa
PAGSSNRSPGSRVRSSLASSGRPGHCSDRRSGMARRCAEGRGGRRASSVAGSPSSQSARRWSSRSRLKRRPIAARGCAGLRPYQTRPGKTLPSRSSKASCRAAGRLAKAASCRFGASQWASAGAWQRKRRGRPSHARLSSRSTSGAAWAMSRRACKALPA

SEQ ID NO: 29958 - protein, 308 aa, Pseudomonas aeruginosa
SRPATGHGHAGPAPPRRRAGAVAPAGAPHGFRLRWRPGCAPARHRAGARDRPAAVAGSRSMPAGVPPGGRRGFAWQAVAQALGRRGAVRMDRFLRVADAPLRGLRRPLSARAANPGHWPAPWTRPRLRFSPGSRGRAVAAHASDLRFAGGRTPAPAAVRRPEAPKRWPAPGLAWTPRRARRPPALAVLPIRTATLLALALALALALALALALALRPRQLARGLAEWSAAGRRQAPRAGRREASRSARRLSRRALRPLSFRRPCRTVAWAPAVGARAGPVRRRSAARAAAEGGQGCRTTRAEPYPRRSA

SEQ ID NO: 29959 - protein, 153 aa, Pseudomonas aeruginosa
PRRVGGSPAARPISRWALAKRVSESISSRTRRPWSRKYSAMLVATKPALARSIAGRSEVATTSTERRSPCSPRSLSMNSRTSRPRSPTRASTVTSTSALRTRLASRVLLPPPAAAKMPMRWPSPQVSRPSMARTPSDSGRSIRRRLIGCGASR

SEQ ID NO: 29960 - protein, 316 aa, Pseudomonas aeruginosa
  UNSURE (265): Identity of amino acid at the above locations are unknown.
KKPADIGIGGTGPVPILRRLCRPGATATMDILQSSSAAPLAPREAANAPAQQAGGSFQGERVHYVSVSQSLADAAEELTFAFSERAEKSLAKRRLSDAHARLSEVQAMLQEYWKRIPDLESQQKLEALIAHLGSGQLSSLAQLSAYLEGFSSEISQRFLALSRARDVLAGRPEARAMLALVDQALLRMADEQGLEIELGLRIEPLAAEASAAGVGDIQALRDTYRDAVLDYRGLSAAWQDIQARFAATPLERVVAFLQKAMSADXDSQSSRLDPVKLERVMSDMHKLRVLGGLAEQVGALWQVLVTGERGHGIRAF

SEQ ID NO: 29961 - protein, 106 aa, Pseudomonas aeruginosa
AYRRRWRAWCNWISRTAAPCSWNAMANSCRSGWPVTWPGTRPIAAPCGRCALCHARAAGSLPLRCAWSGESRLLLCITLEARQVGIPTLHQALQALRSARSEVLAA

SEQ ID NO: 29962 - protein, 231 aa, Pseudomonas aeruginosa
AGSVPGTSASNDSTWRMPSRSRRPCRSAICWRPTAGRWRPTSPACIPRSRRNSACSTTPGPSWSSTACCAPATSARRCAISAWPSRCPASRPCRPRPACSASAMKTSDCCKWPRTCCTRYESMTLKQTQQRLLLMLGWLHLQCGQPRRAQVLLEALLSVAPERRDGRRALLLALLQQGLGEPAVRLCRQLQEDGEEEPGLWLCLSRAEQLAGRLDAARAAHARALELEARE

SEQ ID NO: 29963 - protein, 239 aa, Pseudomonas aeruginosa
VPLREGQQPGRQFRHHGERPLASAERQGQREDHPAQRHQLPLQLGGRGAQPLHPEIRQRPARHSQRDLEVSMNQQATPSDTDQQQALEAFLRDGGTLAMLRGLSEDTLEQLYALGFNQYQAGKWDDAQKIFQALCMLDHYDARYFLGLGACRQSLGLYEQALQSYSYGALMDINEPRFPFHAAECHLQLGDLDGAESGFYSARALAAAQPAHEALAARAGAMLEAVTARKDRIYESDNA

SEQ ID NO: 29964 - protein, 266 aa, Pseudomonas aeruginosa
ARRTALRGGRRRGCPGARQAGREVCRESAGGAPGGAGRGFRERHGGGADAAVRSQPAAPGGRQSCGDRQPGASSGRGCRTGAAGCAGRRFDAVVRRPDVAAGVRDRAGENHRRSREPAEETQADRNRAGAKAEPAEDGGQPAEDQGIGRSRERSPEVRSGSQNLWLDQCNSFDHRRRNHGGNRRRRGRGCTDDRGRCHGSGLPVGTAGSRGRIDQQGSDGKARPGTDGYRDRRRAAGGGGQLRRLSGRRAGQAGREDRRQGGRDDR

SEQ ID NO: 29965 - protein, 312 aa, Pseudomonas aeruginosa
NPAQPVQPTGSDLRRRHMIDTQYSLAATQAAIPSEPIAPGAAGRSVGTPQAAAELAQAPATRGDRVELNAPRQALDPVRMEAAGSELDSSVELLLILFRIAQKARELGVLQRDNENQAIIHAQKAQVDEMRSGATLMIAMAVIAGVGALASAVVGSLGALKNGKAISQEKTLQKNIDGRNELIDAKMQALGKTSDEDRKIVGKVWAADQAQDSVALRAAGRAFESRNGALQVANTVIQSFVQMANASVQVRQGESQASAREGEVNATIGQSQKQKVEDQMSFDAGFMKDVLQLIQQYTQSHNQAWRAAAGVV

SEQ ID NO: 29966 - protein, 288 aa, Pseudomonas aeruginosa
RARNVVRKPRQRMEQEDDKQYSREAVFAGRRVSVVGSDARSRGRVPGYASSSLYRESGIISARQLALLQRMLPRLRLEQLFRCEWLQQRLARGLALGREEVRQILLCAAQDDDGWCAELGDRVNLAVPQSMIDWVLLPVYGWWESLLDQAIPGWRLSLVELETQSRQLRVKSEFWSRVAELEPEQAREELARVAKCQARTQEQVAELAGKLETASALAKSAWPNWQRGMATLLASGGLAGFEPIPEVLECLWQPLCRLDDDVGAADAVQAWLHERNLCQAQDHFYWQS

SEQ ID NO: 29967 - protein, 752 aa, Pseudomonas aeruginosa
AAGESRPYRGIMDHLLSGLATRLGQGPFVADRTGSYHLRIDGQSVLLLRQGDDLLLESPLEHAPLDPQRDQQGLLRVLLSRVASWSRRYPQAIVLDADGRLLLQARLGLDGLDPERLERALAAPGGAARGAGAGAGTAAPRVAAAGSGVASLMRRLLIGGLLALLPGAVLRAQPLDWPSLPYDYVAQGESLRDVLANFGANYDASVIVSDKVNDQVSGRFDLESPQAFLQLMASLYNLGWYYDGTVLYVFKTTEMQSRLVRLEQVGEAELKRALTAAGIWEPRFGWRADPSGRLVHVSGPGRYLELVEQTAQVLEQQYTLRSEKTGDLSVEIFPLRYAVAEDRKIEYRDDEIEAPGIASILSRVLSDANVVAVGDEPGKLRPGPQSSHAVVQAEPSLNAVVVRDHKDRLPMYRRLIEALDRPSARIEVGLSIIDINAENLAQLGVDWSAGIRLGNNKSIQIRTTGQDSEEGGGAGNGAVGSLVDSRGLDFLLAKVTLLQSQGQAQIGSRPTLLTQENTQAVLDQSETYYVRVTGERVAELKAITYGTMLKMTPRVVTLGDTPEISLSLHIEDGSQKPNSAGLDKIPTINRTVIDTIARVGHGQSLLIGGIYRDELSQSQRKVPWLGDIPYLGALFRTTADTVRRSVRLFLIEPRLIDDGVGHYLALNNRRDLRGGLLEIDELSNQSLSLRKLLGSARCQALAPARAEQERLRQAGQGSFLTPCRMGAQEGWRVTDGACPKDGAWCVGAERGN

SEQ ID NO: 29968 - protein, 421 aa, Pseudomonas aeruginosa
HGLEDPLLQRAEPGRRSLARRGPGGAWQRSVAGRPGVARRGHRGSPPGARGRCPGRAPAGMGGGLRASPGRPGASRRSDPAGACRADLRPAALGILRPAAEFSRAFPRSRGADRASAPQVVRPCRRGLAARRQPGAGAVSAGHARRTLVGPPARHGRRGAPGEGARLPARAGHERGGCAAPGRQSPARRLPGGQRPAPGATALPRWQRRGLPTGSTEHGRHSPGRGFHPAEIRLSADPQQQRGQAWLGPAQRRTGGTGRTLGADRRIAGVRGAGPARGGKPGPGGRLAPAPPRAPAGGRRPRPATEFPRARRAHRVERHARRGPAQRLLPPAARVPAGIRQPPEPGAAQSRQARQRRRTGVHDSLGVAGAGALCSARRRPEIPGGRLDIPRCANPRHRAGVDPGGPRQAAFHHQSQRGGAP

SEQ ID NO: 29969 - protein, 268 aa, Pseudomonas aeruginosa
QPWKRDCRSLTARMPQRSGSVCRRRWRSVAGNWPEAPARSASSSCNSRPGPSKAVSAFFRSSQRTKHGADIQPQPGEYPRYRGQCPEGAGQRSEQGRQRSDQGLAGDRQCRQPGAAGRAATQDQQVVGHLQHQLDGDPCAARPDARHPAEDLNMDTSLIRELAELALAGSGQHCHEEALCIAEWLERLGQDEAARLIRISSLANQGRYQEALAFAHGNPWPALEPWFALCEWHLGLGAALDRRLAGLGGSSDPALADFAAGMRAQVRT

SEQ ID NO: 29970 - protein, 381 aa, Pseudomonas aeruginosa
SRSTACSTTSCATATNSTWSHDGYLSDGRPGADHQSRRTLRRPGRRGPRRRVRTGDGRCRQPGRRPAQRTGADQGAFQPGQAGVAGGAVDARRRSQQPDADAVVADAHHHAGRADRQDRRAHEPERRNPDEDPMRRTVKGLSRMALLALVLALGGCKVELYTGISQKEGNEMLALLRSEGVSADKQADKDGTVRLLVEESDIAEAVEVLKRKGYPRENFSTLKDVFPKDGLISSPIEERARLNYAKAQEISHTLSEIDGVLVARVHVVLPEERDGLGRKSSPASASVFIKHAADVQLDAYVPQIKQLVNNGIEGLSYDRISVVLVPSAGVRQVPLAPRFESVFSIQVAEHSRGRLLGLFGLLLALLLASNLAQFFWHRQRG

SEQ ID NO: 29971 - protein, 187 aa, Pseudomonas aeruginosa
RPTSCASARPATSTSRTCPRYCCGCCRRCRTGGDRAFSTPGCWSNWNWTARSACPRNWAGWPFTRRRRWNGPWAGSARCCTARPCGRCWTVRGYGASARRSANRASVSAWSSSTCSSVAGRPAGSGPCRKTRKKAISGAAAWLSGWPPVAMPTAVSRGACACAWRPCRPRRTGPSTNNGDPWRGPCA

SEQ ID NO: 29972 - protein, 247 aa, Pseudomonas aeruginosa
TRRQSRTAGPRAGPVARPRLPGLPQRQPPGGSGPRACRRNRARGPRGLPGAEAPGLGGRTGGGASAPGRADPGNATALQSLLPAGRSPAWRGGAAGGAQGVAPLRRCRADPGGHARGTGIGEQPEAGDPARPAGTTGRGARAGRPGAQGFPRGGLPGSGRRCPAGPGRLHPGNRDRDHRRFARQPVGGVAGRIDGERGAERRGGRGRRLREPGAAPGPGVGSGPRAETLPFARGGDAGGAVGAFRAG

SEQ ID NO: 29973 - protein, 73 aa, Pseudomonas aeruginosa
GRSRTGRAGRWLRRNSARCICRGCRGPSAGRCSGGCSRPVPGPPSAGRTWSACRWGCARRTARRRWHCRLRCH

SEQ ID NO: 29974 - protein, 758 aa, Pseudomonas aeruginosa
EAPVHTACSCMFSRYWIDARRGGVTCRGMPPGGRDIRCSQRGRKSTRRRWANLPVLTGPVARRWRRSGDAGEQLLGRHRPAEQEALQRIAAEAGQELLLGLGFHALGDDLQVQRAAEGDDRRDDCGVVAVVGQLVDEATVDLQFARRQALEIEQAGVAGAEVVDGDADAHRRQLLEDHQAGIGIAHGGRFGHLEDQVAGLQAVAQECVAHRVDQAGMGELQGRKVHRDVPLRMPAVQPEAHLPAGFVEHPLADLHDQAGFFRQRQELVGGDQSVLRMLPAQQRFHADHRSVRRQYLGLVVQDQLPALQGLAQVMEQLQLFLGVGVHRTLEEAVAVPSLVLGVIHRRVGIDHQFVAGLPVAGVERDADARRDPHLVAGYLVRLADPLHQLLGQGRGVGGLSGLDQQDELVAAEAGDGVLGADVGADTLGDFDQQQVAEVMAVGIVDRLEAVQVHEQHGEPAIVADRLLDRMLQAVVEEHAVGQLGQVVVQGQLDQLAVGSCEGGGEHRGTCLEARVQHRDDQGDGDHRQGDHDDQHRQPAVVDASAGGAAEAAQGELRGGHPGVVHADDGAAHHQGGAGADQDDAPAAMAQAEGDPQRGAGGDHRDQDGEAEPQRVVDDPRHHQQGGHPGVVHGGDAAAHQQGAQRQALPGEFRLAHQPEGEGRTADGQQQRQQGQAQVVAERDRQAEGEHADEMHRPDAEAHGESAADQPGERLAAFRQGHPAGHVESGVGRQDGHNQGKGDKNLVVAADKHESVRTG

SEQ ID NO: 29975 - protein, 490 aa, Pseudomonas aeruginosa
SARWHGLCEFPIVRDDKESGMARMFYDEMHDAGGECRSHYREFARWLADTPEEQLLQRRREADLLFHRAGITFTLYGDEQGTERLIPFDTIPRSIPAAEWAHIEAGCIQRVQALNLFLADLYHEQRILKAGVIPAEQVLANDQYQLAMQGLDLPGNVYAHIAGVDLVRDGSGNYYVLEDNLRTPSGVSYMLENRKMMMRLFPELFVRQRVAPIDHYPDLLLDTLKRASDVESPSVVVLTPGRFNSAYFEHAFLAREMGVELVEGADLFVRDERVYMRTTAGPQPVDVIYRRIDDAFLDPLAFNPDSLLGVPGLLAAYRAGNLVLANAIGTGVADDKSIYPYVPDMIRFYLGEDPLLHNVPTWQCRKPKELAHVLAHLPELVVKETQGSGGYGMLVGPAASREEIELFRERLKARPEAYIAQPTLSLSTCPTFVESGVAPRHIDLRPFVLSAPDRVRLVPGGLTRVALREGSLVVNSSQGGGTKDTWVVEE

SEQ ID NO: 29976 - protein, 112 aa, Pseudomonas aeruginosa
RTARTCSAARPSPPACATMRSASSVSEPSSNAPTIPCACSMRATRPRAKRRSPGRTRAPRAATTSGARCCGRYPPSRATPSCTAPRPTRATSPNCCCCARTCRVRCCPASRN

SEQ ID NO: 29977 - protein, 302 aa, Pseudomonas aeruginosa
LANQGVPVLAELFAVMAPVLFGAGVGYVWVRLGHAYPTEFVSRIVFNIGSPCLILATLAHTRVDLHSFGRMALASALICVCMAALGWAAARLGRQEWQVLVPAYSFPNVGNMGLPVCLYAFGEAGMTLAVAFYLIMSIGNFSLGVFWMSGERSWRSLLGNPILLSVLLALLLMGLDLQLPRWMANTVDLMAGLTIPLMLITLGVSLASIRPRQLGNGFFYGGLRLLLGALVGWSVALALQLPPLAQGVLVVQSSMPVAVFNYLYALRGNRSPDQVASLVLCSTLLSFAFIPLLLTWWLPALR

SEQ ID NO: 29978 - protein, 418 aa, Pseudomonas aeruginosa
GRRRPARPDENRIRETAMTDAFIYDAVRTPRGKGKKDGALHSVKPVNLMAGLLRAVQRRNDLDTAQVDDIVLGCVTPVGDQGADIAKTAALVADWDEQVAGVQINRFCASGLEAVNLGAMKVRSGFEDLVLVGGVESMSRVPMGSDGGAWALDPETNLHTSFVPQGIGADLIATLEGFSRADVDAFALRSQQKAAKARAEGLFGKSLVPVADQNGIVLLDHDEFIRADSTLEGLAALKPSFEMMGQMGFDATALRKYSQVERIEHVHTPGNSSGIVDGASAMLIGSEAKGRELGLKARARIVATAVTSTDPTIMLTGPAPATRKALAKAGLKVEDIDLFEVNEAFASVVMKFMKDMGVAESKVNVNGGAIAMGHPLGATGCIILGTLLDELERRNLRYGLATLCVGGGMGIATIIERV

SEQ ID NO: 29979 - protein, 580 aa, Pseudomonas aeruginosa
RYPLRKRPGQRRRPDHGHARAERQHHERCLPRGDGEDHRTAGGGERGDRRRGADLGEEDLLRRRRSQRADQGHQGRRPGLLPGHPRTQGPTAAPGDPRQAGGRRDQRRCAGRRLGDLPGLPPPHRPGQSRRAARPAGGDSRPVAGRRRDRAHGAPAWPGESPAVPRRRQEGASGGSAQGRADPRTGRQPRGNAGEGPRLDPRQPGGEAALGQRRLQDSRRYACQSQRGADAGHRTVGAARQDQGLLPGAREDHVRGSGGRPGRFRHRATDRGALFHRADHRPGGEEHDRHLLVPAQRDQRRQVAAAGVSGAGDEKGRRARRRDDGRGHRLRIGGGRHRGGAQGRLAGSGGEGQGLFGQAAGQESCARAPVRREARRLPRADRAERQRSRLRRLRPDHRGGLRGPRAERQGHRRGREACPGRCGSGVQYLDPADHRSGPGGGAAGEVHRPALLQPGGQDAAGGDHPRRKDQRRNPGARFRLRTADQENADRGQRQPRLLHLAGIRHLHQRRHRHARRRRERRDDRQPGAPGRYAGGAAGDFRRSLPEPDDPHPQPDRPRPRGRGQGSADAPCVRRDRPDGQ

SEQ ID NO: 29980 - protein, 164 aa, Pseudomonas aeruginosa
PRCGYPPYAARRYRPLPPASIGRANSATGAIRRYTEIRRITAMRLSALRRASIQASLQAATGASADVPTRDLGVPRRGSAAGRSRCSTPPGGCGGSDNRDGNRERGRTNPPGPVPGGRRRGARRLPPRWRRQSRHRPAPPVASGAGRRGPAVRSRPPKALSCPC

SEQ ID NO: 29981 - protein, 161 aa, Pseudomonas aeruginosa
GRRGRYCAGAAEGRALRVSAGRGGRQRYRRSRSLRMMVGPHFFLSIEVSSVPSLELTDLDADRQLLALEGVSLLVFTSEGCASCRWARRHLPAMDLPIERLCWVDAGRNGGLVERYGVFHLPALFMVRDGRFHGALNVPLHQEALRGAVLAGSTALPEELP

SEQ ID NO: 29982 - protein, 496 aa, Pseudomonas aeruginosa
SPVATTFSRNLHEASAIALYLGGCAPRPQRLRHGAEPLYFAAGHQQADPPAGGRTGRRGVRSQRQAPDPGDAGGGADHPYRRRDPAQGREHQADRPGILQREEGHAVHRHYPHPGALCAAQRDQRLHQAVPGRLPAHAPGHADADRRNGRRRHRRLRHRHRGAGVVRRPDHDALLPLESLRHRAPRASADQAAETDPGSPGRAADRHLRVRLHRPLQARRSLQPARPGAQGGIHRGRCRRDQDLRAVGPGGRHRGAHGGRSEARQRPGDPRRQPPVRVQRDQDRLPPRHLPARLHVRLHREIRSAPDPRAAGQGRAMPQQGRAGRVVRRHRTAGLLIASAHEKARPGAGLFHGWPSEHVEIVATGQPGQRFAISVRGLLGSRFEDFMEEAHEHGVDLFAPVVVANHEERRGLYAILGGDHPACAVRVAFVGHQGAMDARQVAALFQALPDFLALAAVLAVGEDFLDHGDAHAGSPLGVRPALYPDCIRSIDGFRPY

SEQ ID NO: 29983 - protein, 245 aa, Pseudomonas aeruginosa
PFTPVDLDSRNKPALPCPRRGARVPRPSSPHRSENFEESPVEIACLDLEGVLVPEIWIAFAEKTGIDALKATTRDIPDYDVLMKQRLRILDEHGLKLGDIQEVIATLKPLEGAVEFVDWLRERFQVVILSDTFYEFSQPLMRQLGFPTLLCHKLEIDGSDRVVGYQLRQKDPKRQSVIAFKSLYYRVIAAGDSYNDTTMLSEAHAGILFHAPENVIREFPQFPAVHTYEDLKREFLKASSRSLSL

SEQ ID NO: 29984 - protein, 366 aa, Pseudomonas aeruginosa
KSPRNAGSFLFRGRCPGHPFQGFQQHPDLVQGFLVLVLPVRVGDDAAAAPATDLAVPDQQGADGDRAVHLAAHVEVEQAAAVDAASARFQFVDDLHGANLRRAGDRAAGEAAFQQVEGVLARRQFAGDAAHQVMHVGIAFQGEQLRYPYAARLATASDVVAQQVDDHQVFRAVLGAGQQRRRQRHVLLGGLAARAGALDRPGFHLALVELEEALRRQAEDRAVGQSQVAGERRRAGLAQGAIGRPRRAAASGLEALAIVHLVAVACLDVVLDAADRLPIVGCADAPSEFSQKLEVAGRALRFLAEQGDQALAFALVQSRVEYQLAGAGLVVADQRPGIQADGGQRQAQVIAGVFADALDAPTQVVG

SEQ ID NO: 29985 - protein, 404 aa, Pseudomonas aeruginosa
ACSDHGPSRRGSRQHHPAVADQAVPARRRRVAAASPPGADRPPVRGPRATRDGAQRAGRLRQEHHPLPVAPAPAGAGRGGGMVVLRRDRQRTAASDPVPAGEHPASGPGIRRQYRQSARHRRRGAAGGHPGCLPRRPASPGRPLVPVPRRFPPHPPRRLAAWGSLPDREPARSRAGGGLDPLPPALPGRRTDPQALDLLPERGRPATFARGERCVSPRPQGAGAGRARAEAAVQAHRRLDHGVAPGGPGPQSQYRPGRFPPRALRDRTEHRRLPGGRRAGQPARRPAAVPRPDLGARRVQCGTVQCADRASRRPGHAHAPAERAVVRHRPGRPARMVPLPPSVRRVPPGAAVPACRSDPVAACGGALVRGARPGRPGDQVRPSRPRLPVRRRVTGAPGRAPDRR

SEQ ID NO: 29986 - protein, 321 aa, Pseudomonas aeruginosa
KPGTAERGVSGSRHRSIPWMGWRRKGWPSSLESRTREHEALPNPCPGHLGKQYRTWRPARCRSICRGQDANGSALGQTTPEHWRNNNEKAPVPCNCCSGCSLAGACRPESHGRWRAVRRDRPGRHQHFRYFPGLRRGRDLHRYRHQRRLPAAGEHQPAGADHRRYQAADHRRRHHRYRRQVDPATGHRPAGHHRRRDRWRHQGGRHQRRQHRLADRLRAEHGRFHHQGLGSLIQEPSRDAKTSPRHRRGLSPKEVRRGDVRDFAGKSDRTVRVHPDGRYQAATAGHGQPQPASDPQWTLPRIGATGADEPVAVPQRHPPGL

SEQ ID NO: 29987 - protein, 542 aa, Pseudomonas aeruginosa
RPSNPRARPVMKMRIAPLWLALAGVCLAWIPPAGAQMANDLTIGNPKAMALGNAVTADETGIDSVHYNPAALTRMKGRQATVKLLTGVMDIRAGFKAPPNYGEGTFGLRDDPVANSHSRTLTPTMYLPGLGGMTDVPLLVAPLAGISINPPGSKFTFATNVYTPQALGYSRDSDSDPARYQGREVSLQRLTYFSPTLAYQVNDELSVGLSVGFSHQAVALNEDFRAPNQLLGLLQQTKEIGCLPGMQEILEVFFNVCGGNIGPFQNLANIDLDMQQSLSPSFNLGVLWEPTDWFAWGATYQSESRMKLKGKYRVDYGQGWQGFWTGVHKSLGGAILGQMFPYGNVDEEHGNATMNMVYPDAFSTGVKLRPFKKWQFNFDLKWNGYSDWNEFKIEFDRELDLLRIAKYLDSKDATSHSITLDRGYRDTWSWAMGVQYDVNDRLQLRAGYEYRPSAIPKGQADILVPIGDANLYGLGLGYQWDKDTVIDVGFNYFVTKQSVKADTSCNLNCTGLDNLVYNPYAGLDVDTTVKAYIFAMTYRTTF

SEQ ID NO: 29988 - protein, 847 aa, Pseudomonas aeruginosa
DQRAFLLVENHVHADVAEARQLVATGRQLHEAVPVRQLHTVHRVGGVRVLGDLVVQPGAAQGDAGGQVDAHADGALVQVGLAARLPGRQAQHGHHRVAHQHDDADVRHTFVADALEDLVGGHPVLDQYAVAMTAEGVEAGEDARDVVLDLLVADDLPRHGLVAALEAVGDHHDAVAAGALRRLDDEIVVLADDLVELVDAFLGLDDAVHLRHVDAGLERAFLGDDLVVHHRIQVPLVVLQDVIGIASVDAHHAFRGQVFPGLPDRHGSVLEQGLEAEQLGQAVAAVAAHGEHEGDQDQQHGREGEDEVHQFRDAHEDVRQRCREQGADGHLHRMAAAALFPGDRQAFDGHGQDHHREQGDRQAALEAELVAEQADHRDHHHHEGQHHREARQHLQLQVLEIGAQRQAQGGDHGEQGDTPLQAGLAEGQGDQHRGEGAEGLQADQVAQDQDHQHADRDHDHDLEGLLGGQRQAVQGVLEEGRLGVLVGQLGQADGVHLAAVQAEADLGLLAAVDGHQRLIAKPPDQAIGGQALFAGDHVEIQPVLAVEAAQPQFRALLQVGDQADGMDPLHRHVSDGQQGFDDMRFLFQAGVAGHQQLDVVVVAVVGALDGFADEGLDVGRVLANGGQQGFCGDLLRAFQGQAVAEDRAFLLGLLAGVALGQHQAVVQGLLAVGAAGGPGHLAIAVGAIDADAVIVGDEAFVEADVVLAQRRNEHLHLDRGFRRGDEVDLGIDVPEVIGFGFGNGNTLDENLIGGDRHTQGQQDGDQDFQMQVERAHVVYSAGFASGLQPGFPAEYFKLGSTSASNFFKASEPIKSGYWNALRSVRFTSMVRIALPMQTCSSITGRAV

SEQ ID NO: 29989 - protein, 203 aa, Pseudomonas aeruginosa
LPRAEWPQRPYPRGPGRPGRRRRQRPGQDRRADPPVGDGSRVPGPSRQRDPPGLRRPGQRQRQPRRGSAFLRYRRRPSGRLVRRPAGNLPQYPRRGQCDPRSKRGLRLPVQRPRHRLPRAPGLRSQAGRLVRRRAAHGPLGNRHRRGDVHPGHRIRLPRRGLHHRCLRPGRDRGPGRGEPRRVLRPQADPGSRASGHPAPQPG

SEQ ID NO: 29990 - protein, 195 aa, Pseudomonas aeruginosa
RPGLRHDRPGLGAGDEARQRHRHQPRRAYLPRGDHRSRTGHPGGGRLRQRHPDPAGWPGGDRFLCRRRYRLHLRRRTRFRCAQELGRRHARPSVQDHDERRQSRSRFRFRPVAERRRGPGPPRIHHQPHDRRAPQGIAELRRPAGGHQGKRGEAHRGLSRSGRLLRRETGGGHQHPGRGVLAEEGHRAPVRLQVQ

SEQ ID NO: 29991 - protein, 304 aa, Pseudomonas aeruginosa
PGQHRALAVQVAHGRHPRAPAAAPRRCAVRKPLAAGAGRRAGRPGAGGPALAWAVRPLRRAGQRLVEGARRSRRTAIGGRRGWGPAGPVLGLSQVVRAVRLVRARIPVARTRGWLRRGLRAYRDADRQGGPARGLALGGALAAPAIAGGRRIRVERGARRIGSRNQRLTCDANGGSGHAGAAGAGGRCSSGAARADPFTHRSFPCITSLPICAMPILSWSRSSNPCSATSAAATPSAARSSPSSASKTTRWSRSRSTRTARARSWSSMAVVRCAAPCWATCWPRKRRRTAGKGSSCMAASVTST

SEQ ID NO: 29992 - protein, 351 aa, Pseudomonas aeruginosa
LVPDLCFYCRNGRFTKGSAMQAYESGDERGLIYGYVLNGRGGGRRVGRNQIAVLDLLPEESLWLHWDRGVPEAQAWLRDSAGLSEFACDLLLEEATRPRLLDLGAESLLVFLRGVNLNPGAEPEDMVSLRVFADARRVISLRLRPLKAVADLLEDLEAGKGPKTASEVVYYLAHYLTDRVDTLISGIADQLDAVEELVEADERASPDQHQLRTLRRRSAGLRRYLAPQRDIYSQLARYKLSWFVEDDADYWNELNNRLTRNLEELELIRERISVLQEAESRRITERMNRTMYLLGIITGFFLPMSFVTGLLGINVGGIPGADAPHGFWLACLLIGGVATFQWWVFRRLRWL

SEQ ID NO: 29993 - protein, 95 aa, Pseudomonas aeruginosa
GEGVTPSYRHEVRMHDPFEESLRDLLKASAPQPDDDARLGRVLKTANRQVGAGDLFSLMGHWLQALMIGINNGSPHLAPVSRISAKNASSADKAE

SEQ ID NO: 29994 - protein, 230 aa, Pseudomonas aeruginosa
LAEVAAAFALVAQGGVLDHRQRRILGHASSQQPGLDLRESGDAHVDHQRGTAACQGFPGQRAVVLGMRGHQGHAAADAAVGQRYAAGSGASQPGGDAVHYLAVYPVPGQPFGFFAGAAEDAWIAAFQAHHAASLAGMPQHQALDEVLRCGAAAAAFADPDQPGGRTVLQYARVDQIVDHHHIRVLQGANCLQGQQFRIAGNPHPPARPYRSSSFSSGIRRHGPGGPPAVS

SEQ ID NO: 29995 - protein, 255 aa, Pseudomonas aeruginosa
GWRKQKRRPAVASRTPLSRSRSVGKRRLVVEAGALLSIVGRTQAGAVPTCAIAYLHGLAGITRGLTAVFLPRAGAYRTGLVPLSPSARPGVAPGWRPGTAGRWRARSAAVRAPAMGGVPRPATLLPVAARAAIPRRSRSAVRGRRRRRAAAGRRSRPAGRGDSGWAGRGDRSAGAGRLRSRHRDSARSAPGRGRRRWRRDPGAPRARCRRSIPAPGSWAYPVADGGLRATIPDTRPGRNPAGAARRHGRGGDFPA

SEQ ID NO: 29996 - protein, 204 aa, Pseudomonas aeruginosa
GRGAAGCVDATGQARAAAGWPAPATPAATAGHGCASARRESLRGARASGNTDAGVAPIRTARGNAGPGRGAGTIPRAAGPGLPADRRHVRREGSSAARVGPGHLRPGRAGTGGIRLATAGPASLRRAGRASAVAAVASGPVARGRRRGCLRARLPRVPAGRWRCPGCLPGGRREPGPRRCAAAPRRCAGCCGCRCRPASPRRRR

SEQ ID NO: 29997 - protein, 90 aa, Pseudomonas aeruginosa
AWRPRTGRGRPSRWTSGNRPRRCRWRPGCTPSAGCGCRRCDRRGRHRAGASGCRRRRRRRCSSRRSPGSGRTGRGNSRAGCWPGRGSRRR

SEQ ID NO: 29998 - protein, 137 aa, Pseudomonas aeruginosa
ATGKPLALTASICFSGPTEPGWTGSMPSRAIFSMARACSGMSGRDQASGAGERSSVLVSPGTLNTVSVSFSGTSGLALNHSPSAQDCSTDLAAALPFLARSATSWKASNISRVCFSCSAAVLASSASSSSSTRVAML

SEQ ID NO: 29999 - protein, 374 aa, Pseudomonas aeruginosa
STRSKPTAWHCCRNSATGACRTCAMPSTGNSSCCRKRITSATSRPRSCRRSTDRRCLQRKSRPWAAFSSDQRSLLAGQLLQVGDDVVRLQHQHVAFQGIQHHFRGIADQRAGQPGARHGADHGDHRVELLRGARDQHVGRTFLDVQLFVAETVLGLEGAAGLAIAGLDGFAELEGRVGGGEHRRGVGADHVQRGLGQAGDVVGMADDPGVQGAVLAVVVADVDRGEDLSARPGPGGLGHQYRTGREAQQLPVVRGEDGLFQRVVGKVLLDDQPAAFGLLLGDDGLVQGVLPGLVGRDAVAFLAQLLGQVVESGAVVAALLADQQVQVRLGHAGDQLCPFQGETFQLVRFNHHEDAANGLHDRLPECLWLSLKQL

SEQ ID NO: 30000 - protein, 265 aa, Pseudomonas aeruginosa
CFAERPAWRAWGGSEREGRLAMAVGVDLQGPALAVPVAEHDAPGGLAVDVQRVFGRPMSVAVDQGTHAMPAHDPGHFFGRDIDDVDGFHAGLRAAFLAQLACQLVPGGQRQVAQYPERERVAQPAAQAHVGLVSGAQAVPVHQQYRLAVQVDHARVGQQRASGLAAERLANEEVAIAVHQVDARTAVGHLAQGLGDGALEGVHAVVADPGFEEVAEDVQGLGPAGALIEERQKRPGDVRAFRFEMQVRDEQDAHRFILRRFRPSR

SEQ ID NO: 30001 - protein, 589 aa, Pseudomonas aeruginosa
KSKACQGVDSFGYDKRFDLPGLPWSGESMTKDPMSKPETTAAPNFLRQIVQADLDAGKHAKIVTRFPPEPNGYLHIGHAKSICLNFGLAQEFAGDCHLRFDDTNPAKEDQEYIDAIEADIKWLGFQWSGEVCYASNYFDQLHAWAIELIKAGKAFVCDLGPEEMREYRGTLTEPGRNSPYRDRSVEENLDLFARMKAGEFPDGARSLRAKIDMGSPNMNLRDPILYRIRHAHHHQTGDKWCIYPSYDFTHGQSDAIEGITHSICTLEFEDHRPLYEWFLANLPVPAQPRQYEFSRLNLNYTVTSKRKLKQLVDEGHVSGWDDPRMSTLSGYRRRGYTPESIRNFCEMIGVNRASGVVDIGMLEFSIRDHLDATAPRAMCVLKPLKVVITNYPEGQVENLELPRHPKEDMGVRVLPFGRELFIDAGDFEEVPPAGYKRLIPGGEVRLRGSYVIRADEAIKDADGNIVELRCSYDPDTLGKNPEGRKVKGVIHWVPAEGSVECEVRLYDRLFRSANPEKAEEGGSFLDNINADSLQVLAGCRAEPSLGQANPEDRFQFEREGYFVADLKDSRPGKPVFNRTVTLRDSWGQG

SEQ ID NO: 30002 - protein, 463 aa, Pseudomonas aeruginosa
GKTVLQIYNTLSKTKEVFTPLVGNQVRMYVCGMTVYDYCHLGHGRSMVAFDVITRWLRHRGYDLTYVRNITDIDDKIINRANENGEPFDVLTERMIAAMHEDEARLNILKPDQEPRATDHIAGMHAMIQTLIDKGYAYAPGNGDVYYRVGKFAGYGKLSRRRVEDLRIGARIEPGEAKEDPLDFVLWKGAKPGEPSWSSPWGEGRPGWHIECSVMSTCCLGDSFDIHGGGNDLEFPHHENEIAQSEAATGKPYAKSWLHCGMITINGEKMSKSLGNFFTIREVLEKYHPEVVRYLLIASHYRSPINYSEENLREAKAALDRFYNALKGLPEAAPAEAAEYVERFAAAMDDDFNTAGACSVLFELAREVNRLRESDLSAAAALAARLKQLAGLLGVLQLEPEAFLQAGAEGKVDAAEVEALIQARLEARAAKNWAESDRIRDRLTAMGVVLEDGKGGTTWRLAD

SEQ ID NO: 30003 - protein, 199 aa, Pseudomonas aeruginosa
KAPRTRGFSLPATSVVQVFGGVQGIFQQAGAGHRPDAARHRGDPAGALRCHFVFHVADQAAVGLAVDADVDDDGAFLDPLALDQSRLAGSDHHQVGARHMVGQVAGEAVGHGDGAATQQQLQSHGPADDVRGADHDRIHAVQVGAGAGEQGHDAFRGAGAQEGHALGQAADVVGMETVHVLVRVDALQQQGGVQVGGQG

SEQ ID NO: 30004 - protein, 135 aa, Pseudomonas aeruginosa
LDQDAVDGGVVVQAVDQGQQVVLAGFGGKIVGLGEKADFLAVLALVRHIDLRGRIGADQDHRQAGNAQALLAALGHALGYLLAKVGGDRFAVDQLCGHVGRVTIESGGKRTRIFAWTPPGAKEATRGFAVTPLYS

SEQ ID NO: 30005 - protein, 481 aa, Pseudomonas aeruginosa
RSCQVWPDRQGHDPARPGRLRLRNTGGRDIRPPRGLENAHNCLHLVFEATHWIDRMTDTRNGEDNGKLLYCSFCGKSQHEVRKLIAGPSVFICDECVDLCNDIIREEVQEAQAESSGHKLPAPKEIRTILDQYVIGQERAKKVLAVAVYNHYKRLNQRDKKDDIELGKSNILMIGPTGSGKTLLAETLARLLNVPFTIADATTLTEAGYVGEDVENIIQKLLQKCDYDVEKAQMGIVYIDEIDKISRKSDNPSITRDVSGEGVQQALLKLIEGTVASVPPQGGRKHPQQEFLQVDTRNILFICGGAFAGLERVIQNRSARGGIGFNAEVRSQEMGKKVGEAFKEVEPEDLVKFGLIPEFVGRLPVIATLDELDEAALMQILTEPKNALTKQYAKLFEMEGVDLEFRPDALKAVARKALERKTGARGLRSILEGILLDTMYEIPSQQDVSKVVIDESVIDGSSQPLMIYENSEKPAKAAPEA

SEQ ID NO: 30006 - protein, 76 aa, Pseudomonas aeruginosa
FSRLEYRPVTPGVAGSSPVRSASYEKAHPRMRLSYIRISYPRRAAQDGWSWQFLGAACCRTSGIIPRAGSPRPSLA

SEQ ID NO: 30007 - protein, 502 aa, Pseudomonas aeruginosa
SVVVQRAHGGSVEAAIDVEDLAADTAGQVRTEEGAGIADFLDGDVAPQRRLPLVGGQHLAEALDPGGGERSDRPGGNRIDPGAFRAQAAGQVADPGLQAGLGQAHYVVVRHGPFGAQVGEGQQAAVAALHHFPSGLGQGDEAVGADVVGDAEALAGGHRGEVAVELIAWSESDGVDDDVQAVPVLAQGGEHRFDLAVVGHVTGEAQLRPRAPATGELLHPAPELVVLVGEGQFGAFPVHGGGDAGSDGELAGDSDDQGAFSCEKSHGPFLVCNSVFRACRGHEGSLQQLLRIGMLRRGENRFGAALFHHLAMSNHHQLVAERLDHRQVVADEQVGEVVLALQLPQQFHDLALHGAVERRGRFVEQDQCRFQHQCPGDGDALALAAGEFVGVTVAGLRIEPDLHQRVDDRLLLFGLAADPMDAQAFADDLADTHAWAEAAIWVLEHHLHLAAQRAHVMLRETVQPGAFEADAALAFQQPQDCQAKGRLARAAFANDAQRLPAG

SEQ ID NO: 30008 - protein, 321 aa, Pseudomonas aeruginosa
FEIDPVDRLDVVHGAAEHAFADREPDPQVVHRQQGFTGRVARRRTAGLGVEQLAGIGVSRGCEEFLAGSLLDDPPLLHDADAVGDAPDQVEVVGDQQQGHAQACLQVLEQIEDLQLDGDVERGGRFVGDQQLRLAGQGHGDHHPLPLAAGEFVWIGFQALGRLGDADQLEQFENSRAGLGATQALVQGEDLGELLLDGMQRIERGHGFLEDHGDAVAADPAQAPFRELEQILALVVDAACWVAGDGVGQQAQDRVGGHRLARAAFADQGQGLALADVEADAFDHPLALLAGEEFDGEVADFQNVLAHLISSGRKRRGRLRR

SEQ ID NO: 30009 - protein, 195 aa, Pseudomonas aeruginosa
CGPVRAAGSLPRSVPAALRCRAPPPARSAGCSACTRGCSRPGCWPAARPVAPGNDASAPGCLRRDGRSRRRTGCRRRTAAASPPGGSRRYGRGYGRARGRSRRPGRAPRPVRRLPAPGRGPGSSRWPGREPARRSVPSGPRRRRRGRDGGGSPGYRSTASRDGRPARLPPAWRRRGRPPRSDGLSHLATARCSCR

SEQ ID NO: 30010 - protein, 296 aa, Pseudomonas aeruginosa
RRTGRRSVSWVDVAKQKSLAHSIAYFPVVPASVAAKGKTLEVRMNEPQAFAQTDAEWLASINRARDWFQGPLGSLMLAEERRLLCDELTRYFGGYLVHYGPHAELPPSTGQIQRGVRLGPPLPGVDIACEEGAWPLSEHAADVVLLQHGLDFCLSPHRLLREAARTVRPGGHLLLIGINPWSLWGIRHYFAGDALRQARCIPPSRACDWLNLLGFALEKRRFGCYRPPLASAAWQSRLARLERWGDAWQSSGAGFYLLVARKLVVGLRPLRQSKREPRGQLVPMPVAKVSRRDSEI

SEQ ID NO: 30011 - protein, 246 aa, Pseudomonas aeruginosa
MRSVVLDTETTGMPVTDGHRIIEIGCVELEGRRLTGRHFHVYLQPDREVDEGAIAVHGITNEYLKDKPRFREVANDFFEFIRGAQLIIHNAAFDIGFINNEFALLGQQDRSDVTEYCSVLDTLLMARERHPGQRNNLDALCKRYGVDNSGRDLHGALLDAEILADVYLAMTGGQTSLSLAGSGAEGDGSGRPMVSPIRRLDPARVATPVLRANAEELAAHAARLAVIEKSAGGPSLWAQLEAPVGE

SEQ ID NO: 30012 - protein, 497 aa, Pseudomonas aeruginosa
RPQISRPHRPSRHQGRHRCRRTRAGHRPRTGAGRLQHSLHRQLRRGAHRRFHPPRPGLHSGRRRRCRGKPAPAAGCGRTDPRGPRAGAAIADLRPRRAGDHRERAGRVHGRPAPVARHPLPVRRHRAVPRPPGRPGGAQLPGRAAAAILPCAGRAHRAVQLFLAYAGPRRRCRLSQESGGTGVPPVLRGEHAAFRPVGLGPRAGIAARPYRPPGRGRGPCRAQFRRRPYLLRDQWHFHREQDRLALHGRSRRPGAGGPQLPQVDPPLDHHDRGDTALPDSGTQRTGDHRADPSERIQQGVDRREDRRQPAGARPRAEGEAGGGDQLHLRRPVLQRRADQADPRRQRRGVALRRGLVRLCRVPRVLRRTLWHGHLAQRGGTPGVRHPLHAQDARRLQPGLDDPRAGWRDPEAGRGALQRSLHDAHLDLAAVRHHRFAGRGFGDDGRARRAFADPGDLRRGPQLPPGPGQRTAEPGPERLVVRRLAAGAGGGHRSGRHP

SEQ ID NO: 30013 - protein, 454 aa, Pseudomonas aeruginosa
GVSMAGGEKAGKRGMGFWTCSALVIGNMVGSGVFLLPSSLAAFGGLSLFGWLVSSTGAVLLALTFARLARVNPGAGGPYAYTRDGFGSFAGYLCAWTYWKAAWIGNAAIAVTLVGYLRVFIPALADPLLMVCVAIAAIWLCTLINLRGIGTFSVVQNLLTILKLLPLLLVGILGWFHFNPEHLAIPARSELPNMGYAQAIATTAALTLWSFIGLESATVPADDVEDPRRTIPRATLFGTLAAAALYILSITAVQGLMPPEVLARSTSPFADAARILMGDWGYYLVAAGAVIACLGALNGWVLLQGQIPVAPARDGLFPESLGQLNKNGAPAHGLLASGLLVTALVMVDGHGDLVDVFNVIILLGTMTGVVPYAFCTAALLQLLAVRPDEFSPRSRRQLLVIGSLGFAYSLWALYGTGQQAIFWGFLVLMAGIPMYTWRQWRNQVNGVPTLKAND

SEQ ID NO: 30014 - protein, 287 aa, Pseudomonas aeruginosa
ERQYWIYRGGSVENPSVRSLWPDEAFHPLQRKPVMHTHSPIPRTALVTGGSSGIGLAIARRLRQQGYRIALVARDSQRLQRAAAELGGVPWMAADLSRREAVEAVAAWVGDTFQGLDVLVNNAGFTRKIAATTPLAEAEREWDALLDGNLKSAFLMSLAVLPHFAEEGGRIIHIGSIAAQTGSGSPGALGYAAAKAGLHGFGVALARELGSRGITVNSVAPGYIADTRFFPGGLDPQRVAAIVGETPLGRTGRVEDIAAAVAWLASPEAGFVTGTVVSVNGGWRVGN

SEQ ID NO: 30015 - protein, 363 aa, Pseudomonas aeruginosa
PGGGGSTSRSSGNRPAPTGTNTLSSGFSREEVEMAVFKALWVTEAPHGVYETQVVERDTGDLPAGDVLIRVQYSSLNYKDALSASGNRGVTRKYPHTPGIDAAGVVAESSVAEFAAGDEVIVTGYDLGMNTAGGFGQYIRVPAAWVIKRPQGLSLREAMILGTAGLTAALCVEKLERSGLRPDHGSVLVTGASGGVGSIAVELLAKLGYTVAAATGKLEQAEFLNRLGAKQILDRATVADGVDKPLLKEQWAGAVDTVGGDILFNVVKSLQYGGSVACCGLTAGAGFKASVLPFILRGVNLLGVDSVELPLVVKASMWDKLSLQWKLDNLEEVAREIALEELPGAINQILAGKLVGRVLVNLG

SEQ ID NO: 30016 - protein, 156 aa, Pseudomonas aeruginosa
PLPPFRQQGTHPWRTVPGRDRPVRGVARSRLRQGAQRRGNGQVAGHQLHRLGRGESRLGTLHPAQPRAGGGGGAGRAPAGRQPGALRTDPCGAGGISGRGPVPRDAGRLLCFGGDRPGPRSCPPVAGRANPGGVGRLSRTAGAGGLGQRAGGLRRP

SEQ ID NO: 30017 - protein, 514 aa, Pseudomonas aeruginosa
IVEIVEAALDGFGDRDRLGVGQGAEVAAGAADDVGQQADVGGGEAQFAEFAPEGEEFALLDVGENDVLIMAVAHLAEAVAVGEIGDGLQLFVGDVSRRGAGGLQRERHSDVAGLLVGEGVACAPAGEAGVLRVEPGEGLVEVVEGLVGRIDEMRGDALDFRLGEGARSVLEVGPFGLDALGEDFRGQRLDQDFDPRLVLVVAPAIAVVDAQDGIQVAEQVLPGQEFIDEAADDGGSAQAAADRDAEAELAGLVLHRLQADVVHFDGGTVAHRAVHRDLELARQVGELGVEGRPLADDLAPGARVHQLVAGDAGELVGGGVADAVAAGLNRVHLHGGQLGEDFRHVFQLRPVELHVLPGADVGVALVVVAGDLRQLAQLARGEQAIGNGDAQHRGIALDIETVLQAQRAELLTGQFTRQVTAGLVAELLDAVLDDPLVVLVVYVHEYSCCQAMRLTALTSAHGYALHAEWAHDTSSYLCVKVMFEYMVRTKKTKSPGKHNRFATAPFLSDGRRWS

SEQ ID NO: 30018 - protein, 430 aa, Pseudomonas aeruginosa
TLGGRRVASGLAGGDASFRRALRGPGAQLPAAAVDVLAGRVAHLGQHAAAVQVAHQLDDPLPARAPVGVAVHAVVGDQVHHREAALEQAQDAVHFLQAVVDPFEQGPLVLDRIVDPAGVGLAGFHQFFRAQRRRLGQQLPAQFGAGAVQGQGEGGLHPLPGQALEHAGVADGGEHQVLVADAAIGAEQVDGFEDVVEVVRRLAHAHEHHFLHRSPAPRQDHLGDHLQAADLAQQAAAAGHAEHAADRAADLGRDAQPTARQQHAFHHLPVGQFHQQARRAVARRMLAVQAGDAFQFRCYLGQTMAYAQRQEVLGPLAGGAGIEGAALQPGADDPPAMQGLGAEIGEALVEVLATHGARILPLPVMRRYGRRRRAIVALRSTAATEPFHEIRPPARTPQRRRHRGHRVLAAMQYPPDERRQFPQFQEWRAA

SEQ ID NO: 30019 - protein, 1253 aa, Pseudomonas aeruginosa
GISSSPSWSVIVAKVRRQPALADAGFLALALAVAFHLVLVDLADREVLRLRVGEIPTADRRGGEHRVVLGQADAGQALRIEQFEQGAFLGMVGAGRVARCRADADVLLLDQGLVVEVLVAGVAPVLLAHPLVQPLGAGFGEAVGERLDHDAVVVVALGFVRLGHFLGADPGGGDEAADVVAHAAFLRRDEIGQRQVRLAVRLDRLLPQVVQGGEGLAIGAVDLQVVVLDLVGRPEAEHRAGLDQLLVDQLLQHRLGVVEQRGGGLADHFVGEDARVLAGQVPGNEERRPVDVLGEHREVDLVEHPDAGEGRRRRLVAGPVERRLVGDRLFVAQPLGAGAAVGRAFADHRVVGAGAGHVVGLQLLGQQAGGHAYRARGVGDVDHRVVAVLRIDLHRGMRLRGSGAADHQRQLEILPLHFLGDVDHLVQRRRDQARQADDVAFLGDGGLQDLLRRHHHAEVDHVIAVAAEHHADDVLADVVHVALHRGHQDLALGFRLIAFLRLDEGNQVGHRLFHHSRGLDHLREEHLAGAEQVADHVHPGHQRTFDDLDGTRTLLAAFLGVLDDPGGDALDQRMLEALLDTVAAPFLVLGLLDRAAALVVVGDRQQGLGGLGRAVEHHVLDPVAQRFRNLVVDFQLAGVDDAHGQAVADRVVEEHRVDRLAHRVVAAEREGHVGHPARAQGVGQVVADVGAGVDEIDRVVVVFLDAGGDGEDVRIEDDVFRWEADFVDQDVVGALADFFLARLGVGLAVLVEGHHHHRGAVALAQAGMVLEGLDAFLHRDRVDDALALDALQAGLDHFPLGGVDHDRHARDVGLGGDQVEEGDHGRLRVQHAFVHVDVDHLGAGFHLLLGDLESFRVVFLADQPGELGRTGDVGALADVDEQRAAVDGERLQAGQATGPGNLRDGPRRVLGHCLGDRLDVRRGGAAAAADDIEEAGGGEFLDHHGHFRRRFVVFAEGVRQAGVGVGRDMSVGLGRQFLDVRPQFLGAEGAVQAYRDRPGMPHRVPEGLGGLARQGAAGGVGDGSGDHDRQLHAEFLEHALDGEDRRLGVEGVEDGLDQDQVGAAFDQAAGRLDVVLHQFVEGDVAVAGVVHVRGNRAGAAGRAEHAGDEARLVRGLGGLRVRHLAGQARPFEVEFVGQRLHAVVGLGHLGGVEGVGLEDVGAGVEVGLLDGLDHVRAAQQQEVVVAFHVARPVGEALAAVVGLFQLVALDHGAHAAIEDQDTFPEGVLEGLQAGAAIGERAGHGWTWRQWAER

SEQ ID NO: 30020 - protein, 89 aa, Pseudomonas aeruginosa
RQQAESGEEGTWGARERARMGRGESKHIPVSSKSSSLIARAGLGARLAYVAAEAGGMLAKWRLVPGASSPAVVKVRRREAGLLESPVAE

SEQ ID NO: 30021 - protein, 210 aa, Pseudomonas aeruginosa
RRILHPYLHPRAGVPWTDRHRRDPRQLLGGIPGPRAGPVRHRRQLPRAERAAAGLAGADRRAEEPARPVERLPGQAQRVRRPAPGRLRRRAAADLEHALARQRQRPAEHLPPVRQRLGAQGPAWRGTADPVADGLPAVRANLLRAGGELRCLRQRLAPGADAAVLRPDPQRRRAELPPPDAGRRAPAVARRLVPEQRQAEDVDGLPGLRR

SEQ ID NO: 30022 - protein, 216 aa, Pseudomonas aeruginosa
FTRALSASTDWRKLSAYLRGVAMSAITITEAAQAYLAELLEKQSTPGIGIRIFITQPGTQYAETCIAYCKPGEEKVEDTAIALKDFTAWIDAVSEPFLEDAVVDYATDRMGGQLTIKAPNAKVPMVNEDSPITERINYYLQTEINPGLASHGGQVSLVDVVEDNIAVLRFGGGCQGCGMVDMTLKDGVEKTLIERIPELKGVRDVTDHSNKENAYY

SEQ ID NO: 30023 - protein, 161 aa, Pseudomonas aeruginosa
SGSSTRVRPRCRRWPRGPPAAATGRLCRARRVVPGVAPGLRGAEPSAAGRRGPARRSADRRRRRAGPARCATTAPGSAPAARRVLRRRARRRWRGLSARHPPPPARRTGSTWPRPGRPRCPARRDRTRGNRQSRHRRRRPGRRARRRRRRASARDVGRGAA

SEQ ID NO: 30024 - protein, 309 aa, Pseudomonas aeruginosa
RASASRGRLGRASSSPPQFGHWPPRRTVAQSRQKVHSKVQISASPLSPGRSRSQHSQLGRSSSMGRSSVGASGQHAEAFGVFLGADRKMLVERPPEVFRMAEAAQPGHRGDRRLGVLQQGARGLQANPLDVATGRHAQFLEKYPGQRTRAHAGLVGEGFQGQVAGEVGGNPLQQRGQTRGAARFRGQPGAELGLAARTLEEHHQASRDAERQAAAEVGLDQRQGQVDSRRDAGRGEDVGVAVAAPRVVGMQAVALHMDAGKPLAQRRHVGPVGGRRAPVENPGGGQDQRSRTHRAEPPYARFGGFQPGE

SEQ ID NO: 30025 - protein, 426 aa, Pseudomonas aeruginosa
LIAAEAPGYCRPGLFQRSVRGRGVSMLARDSLVQAGLPDNPYARQLRTGFRWLRFEKELENEFREFLSWNSLMQRRAAIGVAFLIWALFIVADWMMVDIRLHPSLFEQLLGVRLGMIGLLLVVWPAAFLPSLRKVGDAIAPYCLLLINLAVLACDVLFEWHGVPRFTQLGATLGILAVFFPLGLAFWACVRLALLCLALNLAVFLLFGGEENLRTNLLNTLYNGLVVLICSFALYLQDYAQREQFLGRRLLGMMAEQDSLTGLVNRRYYELLAQRALEQGAREEKGVALILVDVDDFKAYNDHYGHPAGDAALRQLGVVLRQGARRPLDIAARLGGEEFAVLLYDSEEGNTLAIAERLRQAVEALGIEHLGSSAGPCLTISLGVAYSTSGMGLDALYREADRALYEAKDAGRNAVRVAFRQHDRLE

SEQ ID NO: 30026 - protein, 330 aa, Pseudomonas aeruginosa
RAEAARRGVLSQNSRRAARPPCARCPRLHSLEWRPTCGSGPLRMDIDLARTFLEIARSGSFVAAAERLHLTQTAVTARIQNLEGQLGCRLFVRNRAGARLTADGEHFLGYASQLVQTWDAARRDLPLPDGFRNLLNLGGEVSLCNPLLLNWMRRLREAIPGHAVRVEIGQGADLLKQLEQGALDAALVYQPEYWPGLQVEQLLEEKLVMVRSVLSAEPYLYVDWGPDFRSQHDAALPDRAKAALACNLGPLALQYIMQNGGSGYFRTRVVSSYLDGGTLQRVEQAPEFAYPTYMVYSRERLSPTLRHAFQLLREVVREDSDWSQRWDYVI

SEQ ID NO: 30027 - protein, 227 aa, Pseudomonas aeruginosa
ALRPPTRAATRLPPSIDQGCARGLEARANSSTADAPSGAARRSASSLPNNAWQANTAASAPMQAPSPARRQSRGRAFRVRGRKPFSQVRTAVLGESFMELFEAKERGRCRPRKALSCWRHPSLDDGVGSGEERRAGGLAGFLEGADHLPADLAGIPGDPAGGLGIVGEWQQGGLFAFLAGTAGEPEGEAERQGGEAQQGQQHVQAPWPAARTGCRWSCALRRVRQVL

SEQ ID NO: 30028 - protein, 85 aa, Pseudomonas aeruginosa
TPMVITRAMPTSTSTWVVKLDSATVPRVMAMISAERMKSVRIAPPIFCFSRAATSTLAASAASSACSSSWGRYLWAIFSKPSKHR

SEQ ID NO: 30029 - protein, 211 aa, Pseudomonas aeruginosa
APPSISSGITAQGAKALINSAAGTRIALFRSEPLATAQTTGSSRSALTPVTCWALRARSSPRTPAVFFAATLVISETSSSTAAISSRRVRRLAPAILGFLTGWWAPPSWRGVYLTPDRGGGTVPRVGAREPPHSSLAQAFERGLPGPGGRWPARLRSPRGCRPRRTRPPRVRSRPGSIAAGGGAAGRWRRLRSPAGARNGRAPGRSSRRDW

SEQ ID NO: 30030 - protein, 356 aa, Pseudomonas aeruginosa
AVRGRNALLRHWISSASPLRRDGAPAAGGCCGWRRARRRVATPSARGRARNRGIRSRSVSGAQALLDEVEEALDAQRQLRVAIVDGVDRLPVFAHLFGEQRHQAPVLDIAVGHEAGQAGDALVAQDQLAERLAAGGRDIRLDLQAIAVGVHHRPAVEVLGLGEAEQGVPSQPLDARRRAVAGQVLRAGEDVQAAGAQRARVQGGVAERTDADRHVGALLQQVDDQVVGVEFELDVRVQPAELADVRHHRVQHEGRGGVDPQAPGGALPAQGQAFLERLHLLQDLPCLVEEVAAFLGQLHAPGGAVEQGGAELVLEAREGPADGRGGQSHLFRGGADGTAVDYTDEALQFIGVGFHS

SEQ ID NO: 30031 - protein, 85 aa, Pseudomonas aeruginosa
SNICTETTRVFSGMLPPIISTTPNSPTVWAKPRIAAVTKPGRASGRTTLKKRSTGLARRVAAASSGFSPIASKAFCNGCTTKGSE

SEQ ID NO: 30032 - protein, 581 aa, Pseudomonas aeruginosa
SSSGRRRLIGCALPSRGGAGICMHEQYQAPLPVNSPALPEPFYYLHNFRAVLAWIGERYADLLDDQERAFIAAFAELPEASQALLVRMVMRKGTLFREGKLAYAEIGDTRAAVQPLLALGWVDAQPTLELAQLFGLLKKDELSQLFRDHLGRANLRKDALLERLQPLFPEARRLAEWQADFAEPVYELRCMALCDRLRLMYFGNLWQDWSEFVLADLGIYRYESVEFSADSRGFRLRADVDAYLHLFDCRQRFDLGEPLEELLAGLPGEPYANPWLEGRRVKLLFQFAQHCEKQRDFDLAQRLYRQSSHPGARLRAIRSLERGERFAEAHALAREASCAPESDAERQGLARLLPRLQGKLGLPRQARAAAPEIDRLDLCLAFPSEPCSVEWAVREHLEEPDCAVHYVENGLINSLFGLLCWEAIFAAVPGAFFHPFHSAPADLHSADFRQRRAALFEACLGRLEDGSYRDAIRCRYRDKFGLQSPFVYWELLGEELLEQALDCLPAAHLRAWFERLLEDIPGNRAGLPDLIQFWPAQRRYRMVEVKGPGDRLQDNQLRWLQFCREREMPVAVCYVRWHVDD

SEQ ID NO: 30033 - protein, 256 aa, Pseudomonas aeruginosa
AGRRGAVPGGGARALRVQRQARRPRPALHPVAQRPGRHRRTYPGDLPAPRSLPARSGAGRTLPSLAGARPGGWLRSAGELPGGNQDPPRRPRPATGQPPAPALGPGQGLRLAALRRTEAGGSRTGAGLPGGRQPEGDPLRRAGAGRRAAAVLREPVPGVSRLGRAGTGAPPAARPRTGRVTLSPRRIPPRPAATGGGGVQGRLRRLLPDGPGADRDRQDHRHAVPATQGDARAAPGPAVLPGRQDPGPGPRAACPA

SEQ ID NO: 30034 - protein, 414 aa, Pseudomonas aeruginosa
PGRGDRRTAGAGAGTGGAGQGLRAPGQGLPRRVLSPGPGLLRTPAGGPRRRRGGALAGPGAVARGGAGAPGLSLLPGPGTGALVRPGGGRLQLLLRSRRHAPWPGPGQPVAGGGTGGRGAQPGGARPADVFRRTRPGRFPRCAQNRPGGPEETAGAHPACLERTGQDPGGRLPGLRRASAEAAPGLAERGGGDQRPARRATAGAGAGVAGVLLRDPAVRPSRRAVRRAFAVRHREAPRPQRPQPGPAVPAQRGAGGVSRRALRRQPLHRAVLRYPWAARLLRRPARPAGGHALAGSGLAIQRRATGGAHTASGFHALCAAPGIPGAHRSDSRRAVSPAAGQLPGLLQQLRLLAAGAGRLPPGIPVGAVLEPDATDGRGGAPGLPRALRRGRARASASPCSAVPSAKASTCLASA

SEQ ID NO: 30035 - protein, 463 aa, Pseudomonas aeruginosa
RRCTVLRRATRPGRNTGGADQAIPSEAMSPGCWLSRFPFDDQELPMQHKRSRAMASPRSPFLFVLLALAVGGTANAHDDGLPAFRYSAELLGQLQLPSVALPLNDDLFLYGRDAEAFDLEAYLAVNAPALRDKSEYLEHWSGYYSINPKVLLTLMVMQSGPLGAPDERALAAPLGRLSAKRGFDAQVRDVLQQLSRRYYGFEEYQLRQAAARKAVGEDGLNAASAALLGLLREGAKASAVQGGNPLGAYAQTFQRLFGTPAAELLQPRNRVARQLQAKAALAPPSNLMQLPWRQGYSWQPNGAHSNTGSGYPYSSFDASYDWPRWGSATYSVVAAHAGTVRVLSRCQVRVTHPSGWATNYYHMDQIQVSNGQQVSADTKLGVYAGNINTALCEGGSSTGPHLHFSLLYNGAFVSLQGASFGPYRINVGTSNYDNDCRRYYFYNQSAGTTHCAFRPLYNPGLAL

SEQ ID NO: 30036 - protein, 443 aa, Pseudomonas aeruginosa
SRTTRYRSWSDARAQAVRAQGTAAWEGSHLAPFPGSADVRVGHAPRPGGQGRAGDPPGSTIRDGRSGPCRHRGGDGQRGVLPLRDDVRGAAGVRLRRDRLRSHRVADAVRLGSGDEQGRQRQRDPAQAVRGGAGGARRCGAGYRRDLPRRACLGAPGGGGALTHPAPRRHPRDDPGARRRRLRRPQRAGSRQSGTVAGPGAVVAGEGQPAGRAQPVRDPGRPGARRPGGARADVAATLPGGQRYGAGDPRIAFAAQGPGGRQCRRGRGPRGQGVAAAATEPGGQRAAPGDRRASGKRLGGIPALPHGHLPGAFQLPPADRRAAAPGVGEMERRRDAARHPPATAEPLRQRRHAALAGTVADPAGDRVGAGRRVVSRTVRGWPARRDRPAQRAARAVRGRAATDQPADRTQAHRVSGGRASRPVGSAIGEPAESWKLRKPRITS

SEQ ID NO: 30037 - protein, 239 aa, Pseudomonas aeruginosa
SSTTTPSSTRCARACCCSAGSLADRSATPNWWTACRWSTVACRCTWWPARCAAPTSPPRSPASRCAGSIATCCRPCCCSTTAAPWCWWATTASTPRCWYRRATAEARGCRWPSWKRCTAARRSSPSAATGRTGGSATTPAPCPNTGSSARSSGSGVPTPRSPPRRWWPTSWRSPRHCSPCRSTTAWCPTRRSTPCGSSPAAWPWRSSSTVSCGSCAATCSTCSASASTCNSRPCCSPAC

SEQ ID NO: 30038 - protein, 420 aa, Pseudomonas aeruginosa
SWTARWSRWCRATRYRHRRPPKEATMDSDRDAAALRRQLADPLLAATHPVYRPLLWTLLGCVLLFIGWAAWAQLDEVTRGDGRVVPFSRIQKIQSLEGGILDRLLVKEGDLVEVGQPLVRLDETRFLTNFQESANQASVLRAAIARLDAEVLGKKSIEFPPDVDPEGPLARSERELFKSRRDKLVEGTQAIQRQIHLAQSQLDLVRPLVAKRAVSQMEALKLSQDIATLSGKLTELKSTYFQDAYTERAQRKADLSALEPIVQQRQDQLRRTEILSPVRGRVNTVLINTRGGVIQPGEPIMEVIPVEERLLVEAKIKPRDVAFLVPGMPAKVKITAYDYTIYGDLKGTLEQISADTIEEDTPHGKESYYQVLIKTDGSQLKRGEEVLPIIPGMVAEVDILSGKRSVLNYLLRPLIKARLY

SEQ ID NO: 30039 - protein, 953 aa, Pseudomonas aeruginosa
GHSERSSSSPRGTPNCAARAGEQANRRWVRSQIRCTGCGLASTRRASAWSAAASRRAPSRRSRRARSSTSSAWVPDSQREMVDCATPSNSAACVCLTRCSRRQRRRAGPRDEEGRGSVMLGYAGEWTLKSAPDAGRRQIGATPGRPVWSAAILGGPPAPRRQPWSCRRASRSGLGEGGGEGQVVQALPGGGEDRIGQRRADGRHTGFADPGGRFAGGHDVHFDLGHLGDPQHLVAVEVVLLDLAVLQGDRAVQDRAEAEADAALHLRGDHVRVDRDATVHRTDHPLDLQLAVLVHRDLDHLGDEGLECLGHRDPAPAPGGQRPGRVPAGLFRSQFEHAAQARLLCQQVVAEQVGVLAGGLRRLVDERLHRVDRVRAADHPPPQDRHADLGGAQLDRDIGHRIGQVGGAFHRGGVDAVLDHHRGERRAFQDRLADDAMLPADQLAVGVEPGFEPVVVHRPVETAVDVVLAGPLQLHRHAVGAQRLGDRYRLDDIVRPGVGAPAEAAAGVERIDLHLLRLQPGGARRVALVDGLELVAGPDLAAVGGQPDHRVQRLHRRMGEERELVAGGDPAGRPGHRLGGVAVPARGLAGLLGELAVLRHQRLGTTLLGLALVPLDLERVAALLRRPEALGDHRHAVRHLDHLDHPRNRPGRRGVERFHRGAEQRRALEQGDQHAGQADVEGELRTAVGLAGNVDARRLVTDQAEVLGILQLHFFRHRQFRRRSGQRTVAGLALAGRMFDEAVAGAQFGGRHSPLAGGGLDQHRARLGPGLAQLHPGVGHRRTAAGALHGAEGQVGVALGVGGRAFHADLAPVRVEFLGDDGGDTGIGALAHLHVLGDHRDTVVRGDPQEGVGREAGVRQGRGEGTPGSAPLEADGQADHRGAFEEAAARAGQGVAQIDLAVHGVRPSGCRRLRGWRRGSAHRRRSGRCCRSSRHRCRRRWGWRSAPAARWRT

SEQ ID NO: 30040 - protein, 178 aa, Pseudomonas aeruginosa
INPAERPGGARRGNAAKQLRRRRRSPGIGNALGSLPSVTDARPGGTHFQPEAGRPVFPLSLRGDDPAERLKMAWIYLLLAGVFEIVWATAMKESAGFTRLWPSLVTLLFMILSFGLLAVSMKTLPLGTAYTIWVGIGAVGAFALGILLFGESPSPLRLLAVGLIVAGIVILKLATRQG

SEQ ID NO: 30041 - protein, 136 aa, Pseudomonas aeruginosa
GATIMYASFAPATWALLAYLFGALALCLLMLGLGRVLGGRSHGRAKNLPFESGVDSTGSSRLRFSVKYALVAMLFVIFGIEMPFLYLWAVSLRENGWAGFVEATLFVSLLLVGLFYLHRVGALDWSPERRRKKPHD

SEQ ID NO: 30042 - protein, 296 aa, Pseudomonas aeruginosa
PLAGSSHTSCCARRQSGSAGACASPSSSERATPRPPARRPRTLAVGLLWLRSMREIIALLTAQRSASWARVSSRSLRRAARRRAISSSISMSGPGGFFSSMIVTVQYIGNSPLHWSLPAMTEPTIRRLAGEEILARLDELAEVLLDCVEGGASVSFMWPLPRERALAFWRGVGESVAGDERLLLVAEAEGRIVGTVQLLLDQPPNQSHRADVAKMLVHRRARRRGIGEALMGELDRLARACGKSLLVLDTVSGSAAERLYLKTGWTRVGEIPDYALMPDGTPCPTTYFYKRLAAAG

SEQ ID NO: 30043 - protein, 151 aa, Pseudomonas aeruginosa
KKNSASTAPSSCNSRPITGVFSCPPCAAPRRAARNATPAWCAAPTVARRWSSRAWRPCAPTGRRWPSASSRNSTCASSIASPTRTTCAITYDGPWPASWTTCWSTASACAGASTITSATCRRMCARRASPTTTTSSAGARGSTRAAAGSAT

SEQ ID NO: 30044 - protein, 425 aa, Pseudomonas aeruginosa
VALSSAALAAGAIRGASRTTAKPIRSRLERVFIEDVLFAAGAGFRELPLQPPVHGRGFEVVEVEALAEREVLPHRVVALPVVGGASRTFVDGLADGGGHEGDHLVVEDIVVVGDEGLRGVDEVDRLVAVAGHARQRRIGVAAVRAAEAPEAPFADIGVVDHPWFGRSWRAVVAAIRQRALAVDQQGGPIQAVVAEGGGIQVFFPEAIAGSVVGPVQVHLAPGEVDADPLAEREGEVGGAVAVGTDDVQQRRRPGSQGADLEAVLLEQQALIGLYRRIQHDYRVAEGAYPLTVLESQQAFEQRVVKCAEGDCAAEAVADDHQIVPVLAIDPFQLGEQLGDATPADFLGDGLPVPVGQVLAIQAMHRLAPPANIEADQPAFAQHPGGGEIGECLVEAGDVAVVPSRVVLPTVNKHHHGDVPPGGVAL

SEQ ID NO: 30045 - protein, 585 aa, Pseudomonas aeruginosa
SGGSLGCGLVGVGLVGGIGLRSEPGMVLAVPVDDSERVRLAAAEVVAQDQEVLPHAPGLGHRAELRGARLVGRALRRDAPEVHSRLAMVEVVAGQVLHEGEHPQRDVDQQHAQAPANERQGEGQALLVGRVGAAEEASPAQRAVVQEARQAVLVAGEPEVLGDVLDPRRVLGEDEDREQVEQRERLQVAAGVHQAEQRSPVERPADALVARGGDEADVETELQVLEDPRRMEGREHQAGPEGALGHALVEAVLFHEDQVDVVLGIEGAHAVVFVHVQLHVLVARGVQDRDRQDPLAGEAGQRLVLQAGAMGGVVEGMEEATLAVDHQAHDQRAQQALQPQWLLRGEQLLAVDHREEEHRVAPTDVQVELPGLEQGVFRPSRRAVVQRLAGDPGPERLAGQVLVGTAHVDAVSVLGVSGLEQFILHGAGAPSLQVVGSDVERRDGREERVERLHPVVIDGQHDEVVEALAEEFSHQCVLGGLGDEAGPDLLARLAGEPFLVERQARQEDRFQGRVVQPGLAVVALFQALDDLAVGPVPAVLAAAHLEERAGRGRAGQGPGDPLELALDLAEETLAGLAGGGVAVER

SEQ ID NO: 30046 - protein, 366 aa, Pseudomonas aeruginosa
TMDDLLQRVRRCEALQQPEWGDPSRLRDVQAYMRGSPALIRAGDILALRATLARVARGEALVVQCGDCAEDMDDHHAENVARKAAVLELMAGAVRLAGRRPVIRVGRIAGQYAKPRSKPHEQVGEQTLPVYRGDMVNGREAHAEQRRADPQRILKGYAAARNIMRHLGWDAASGQEANASPVWTSHEMLLLDYDLSMLREDEQRRVYLGSTHWPWIGERTRQVDGAHVALLAEVLNPVACKVGPEIGRDQLLALCERLDPRREPGRLTLIARMGAHKVCERLPPLVESVRAAGHPVIWLNDPMHGNTIVAPCGNKTRLVALIAQEVAAFPPGRVRLRRRGPPGCTWKNTPGQRFPMRSPIPRACPN

SEQ ID NO: 30047 - protein, 317 aa, Pseudomonas aeruginosa
NVALLCVARSNSVMSESRLLTLRDYIRWAVSRFHAAGLFFGHGTDNAWDEARHLVLGSLHLPWEISDSYLDCRLEDDERAELAEILRRRIEERIPAAYLLGEAWFCGIPFSVDERVLVPRSPIAELIEQRFAPWLPAEPARILDLCTGSGCIGIACAYAFEQAEVVLADLSFDALEVANVNIERHDLGERVYTVQGDGFAGLPGQRFDLIVSNPPYVDAEDFADMPAEFHHEPELGLACGDDGLDLVRRMLAEAADHLSEKGLLIVEVGNSEVHVQALYPEVDFTWLEFEHGGHGVFMLSAAQCREHRELFRSRLEK

SEQ ID NO: 30048 - protein, 410 aa, Pseudomonas aeruginosa
RFDRVLRGRFAGPSLTGILRCLSLSSSRGASHVRQHLRQALHRHHRRRKPRPGAGRHRRWVPPGAGTVRPGPATRPRPAQARHQPAHHPAPGSRRGGDSFRGVRGQDHRHADRPADPQHRPEVQGLLGDQGPVPPGPCRLHLPPQVRRARLPRRRPFLGARDRHARGRRGYRQEIPGGPGHPGARLHEPARADRDSVQELGQRRAECLLQPRPGQGAGAGGLHGPIAPRPGFGRGEDHRGCRRRAAGPGRADLRPPGRRTGACADEHQRGEGRGDRRRLRQHRPARHRAPRRTDPARLPVEQCRRHPRRDLLRPADRRPPGAEADLQHHHSRALDRYRRRAGGHDHQGPSRPVRRHPRHADRRGDDGHRPARPIAAPAWAERRRARRHAGPAAAVRAVAGSDAGRVNGGS

SEQ ID NO: 30049 - protein, 189 aa, Pseudomonas aeruginosa
TESTESEPMSSLTVYHENQPEQPLKLLTHAEDIASTLAEVGVRFERWEAAAPIAAGASQDEVIAAYAHEIERLKRERGYITVDVVSLNSDHPQKAELRAKFLDEHRHGEDEVRFFVAGRGLFVLHIEEHVYAVLCERNDLISVPAGTRHWFDMGEHPHFVAVRLFNNPEGWVAQFTGDDIASRFPLLED

SEQ ID NO: 30050 - protein, 348 aa, Pseudomonas aeruginosa
GRCRTRGEVGWLMGRRYLSGAAGAIRRRGSTCHCRQRRMRAFLRGAGKSRCQIAALPGRSRPMSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKAFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTREGLRRLPLETLRQRFRDSGIATRYYNADIHLGAFALPQYVLQAIGKQDND

SEQ ID NO: 30051 - protein, 341 aa, Pseudomonas aeruginosa
RASLAAAARRAAAGDRTAPAFRTVHTAHRARPLPAGRAGAGPHSGNRTTEERIVNMDQTEVRTTQSPPRLFQPTIRSHLAFTALSALVLLVMFSLLRLALLIYNRELIGATPASTFLEAFGNGVRFDLRVVVYAVAPLVLSLFAVRAMAARGLFRTWLTLFASITLFLGVLELDFYREFHQRLNSLVFQYMSEDPKTVMSMLWYGFPVVRYLLAWAFATWVLYRVFKAIDLATRPSQRKLREDSVIARPSAAAPWYVRGVVLFLCVLVCVLSARGTLRQGPPLRWGRCLHHRVHVRQPVGPERHPDPGQGGQGALLRRTARTSGMPPCTTMSPWRPPGRCC

SEQ ID NO: 30052 - protein, 719 aa, Pseudomonas aeruginosa
PGSAVGRVRAGPRRRRGRGCRACRAVPVAWSGVGSAPRGVLREPPAALRRGDDRQAAATGRRAPGCAARWRPAAGRAIAATGAAVWPGVAPRGAAAGVPAASRDRRRARAPGAGRRVPGSNAGPSQRVVAPGSGRTRPGRERRCLRAPARPVAGPPAGWRRLPPAGSARASGRAPEPGRESAGAGRPTPGSVRDRRRGRPGRCPGALAKRCRHSGDGNARDVAGDPVRRGWRAAGRGPYRSFGLPLFMQVATLPRALAAVLLLVEGELHRLFRMQPLQAFEQLATGLLEKRQAAGAGTDLDLQLAMAMQDLHLHGAELGQSHLQARRMAFGCAGDLDAPLHGIEQAREIGQRQWPAPARCQQACHQAVAGGLHGRQWHRRLVVGGQCGWIGFSGLPTLLSAAFAARCRRGRRILDTGLRRGRDLGCGFRREAGAGLWPLMRPTCDLRVGGHRHQRRFVDRRRRNAGRLPGLRGRRDARGDRRRLPCYRSGRRHCWRWRWRWRWRWRWRWRWRCVRGNWHGGLPSGRRPVGGRRRGLVGERRRGRRVGCRGGLFGLCRFVALVERWPGRRRSVRGQGLFEGDLLRAQRRKGGRGVGRHERSRIHGVQLEHGQVSWRVNSSSSPSSLRSRSPWRSASTWRSSSANFSSCRWRSSSSRRHCRRRSRSPSRRCAVSAQSCSRPASFSRSSPTCCCQASRRRRSSMAAWQARNSRCSSASRQSR

SEQ ID NO: 30053 - protein, 122 aa, Pseudomonas aeruginosa
SRCAAWRSVCSCAAARTRSNWRPWARSARSRRRRRTRNSSARLMRRGSATARRPVRNRWFRGYPGAATGGSPRSSRWPGRLRCPGLSGIRRSSAATRLPRTSPAIRASVRPHGADRRRRSGS

SEQ ID NO: 30054 - protein, 97 aa, Pseudomonas aeruginosa
RGSGAMAYGPSELTGAVIALLEKRWVGVAEVQALLEPLPLADVARQIHFFRELKRLYRLLPVEVFGDDEQRQNLLNACQMALDLAIEREEEQQHGLG

SEQ ID NO: 30055 - protein, 175 aa, Pseudomonas aeruginosa
PGLAPGLSRHPAGVAPCAMRARPGACRCVAPGAANRACCCASPWKPGRSASRRCTRPCRRCARRAAKCSPHEPGRCLAHRHRTTRPGACRAVRAAPAGAPSAGARRPAGGDPRRQPVSRAAGATAPVRLRPAPAGVPRPAAPRRLPPGAARSPPGPHAAPPAGPAGRGLPARRAR

SEQ ID NO: 30056 - protein, 875 aa, Pseudomonas aeruginosa
AVPNSSPGVSTRRVPRTPGRWSWRRGNERPERASRPGRRAQGHPAGGVAAGGGVHDGAAAATAAAGHPHRRQHHHLRGPADDVGVHRLAVAVLGVPGGAADHHAVPPGAVGEHHADDPAAGRRGADRQHLRQLRGRRQPGGGHHHLPDHHHRAVPGDHQGCRAGRRGQRALFPGCHARQADEHRRRHACRRDRCQRGAGAARGDRKGKPDVRLHGRRDEVRQGRRHRRADHHRRQHPRRHRHRRHAEGPEHRRRAATVRGADRRRWLVSQVPALLIAITAGISSPGVFRRIGGPRQRHRRTGGGAAQGAADRRPVAGAVRPDSRCPDPDLPGSRAAGWRRRLLHALAPAGPCQRRFPRPAGAARAGRRSAIGQGAWQGWRRQAEGRASRRAGRIRPHRAVADRRRCQPPGTSRGDVAERGAGAGTTRVVPGFRRAVPGYPLALQRSDGRWRIPGAATGGPGRARMPAAGLVAGARTRRAAGTARGPPRAGRAAGAGRRGELGGAGASGSPGAFRLCLPGPGAGAHLAPVPCAAGVRRGFHRHPGDALPAGADGAGLRRAGEGGAADRSPAADDRDSPAPGRRGHLDPQHAGDPRGDGGVGAEGEGRGAAHRVHPQQPQALHLLQVLQRQQYPSRLSAGPGGGGADPRWHPPDQRRQLPGPRPGDNPGLPRARAADRRRSRADAEPAGADRFHGYPPLRAQAGGERLCRAAGAVLPGADPADQHPAAWQDRVVSADPLIPWFLARGLAVRPHCLRDTSIALGWQVLAHGCELAWRCDGERVWIVMLRRRQARSGLANPFAALYLLAEATLDTLGPRQRLYGKVLALAGSPLPGERMARFYRRWTGAAEPADGWFELEAGRVVTQRSLRKRQKPDRA

SEQ ID NO: 30057 - protein, 107 aa, Pseudomonas aeruginosa
QAPATSIPTMDDMNEYTEDTLRATVQAAELAIRDSEERGRLLAEMWQGLGLAADAGELLFQAPERELARAAEEELLAELRRMRSSQPTQGEQGTRPRRPTPMRGLLI

SEQ ID NO: 30058 - protein, 297 aa, Pseudomonas aeruginosa
GITMEVRNLNAARELFLDELLAASAAPASAEQEELLALLRSERIVLAHAGQPLSEAQVLKALAWLLAANPSAPPGQGLEVLREVLQARRQPGAQWDLREFLVSAYFSLHGRLDEDVIGVYKDVLQTQDGKRKALLDELKALTAELKVYSVIQSQINAALSAKQGIRIDAGGIDLVDPTLYGYAVGDPRWKDSPEYALLSNLDTFSGKLSIKDFLSGSPKQSGELKGLRDEYPFEKDNNPVGNFATTVSDRSRPLNDKVNEKTTLLNDTSSRYNSAVEALNRFIQKYDSVLRDILSAI

SEQ ID NO: 30059 - protein, 397 aa, Pseudomonas aeruginosa
PRERIEYMNPITLERAGLPYGVADAGDVPALGRPVARYVESLRVERLAAPAAASASGTGVALTPPSAASQQRLEVANRAEIASLVQAVGEDAGLARQVVLAGASTLLSAGLMSPQAFEIELAKITGEVENQQKKLKLTEIEQARKQNLQKMEDNQQKIRESEEAAKEAQKSGLAAKIFGWISAIASIIVGAIMVATGVGAAAGALMIAGGVMGVVSQSVQQAAADGLISKEVMEKLGPALMGIEIAVALLAAVVSFGGSAVGGLAKLGAKIGGKAAEMTASLASKVADLGGKFGSLAGQSLSHSLKLGVQVSDLTLDVANGAAQATHSGFQAKAANRQADVQESRADLTTLQGVIERLKEELSRMLEAFQEIMERIFAMLQAKGETLHNLSSRPAAI

SEQ ID NO: 30060 - protein, 149 aa, Pseudomonas aeruginosa
EAPPMDLTSKVNRLLAEFAGRIGLPSLSLDEEGMASLLFDEQVGVTLLLLAERERLLLEADVAGIDVLGEGIFRQLASFNRHWHRFDLHFGFDELTGKVQLYAQILAAQLTLECFEATLANLLDHAEFWQRLLPCDSDREAVAAVGMRV

SEQ ID NO: 30061 - protein, 69 aa, Pseudomonas aeruginosa
NWYFCSASKESWINWRKPTRSANQRTSDNPDYYKIDSVLMALKINKTERIHASPLGGAFKVRREVLGFL

SEQ ID NO: 30062 - protein, 135 aa, Pseudomonas aeruginosa
ADWPLAWAKGPLLPIGRVRTTCASTDRASCCCARATTCCWKARWSTPPWTRSATSRGCCGCCCRGSPVGVGAIPRPLSWTRTGACCCRRGWASTASIPSDSNGPWPPQVGLLEALAPELEPLPRGLPPQAPVWRP

SEQ ID NO: 30063 - protein, 452 aa, Pseudomonas aeruginosa
PTAPVPRTAPGASARSAGISMAWKIRFYSGLNQGAEVSLGEGRVALGSDPLQADLVLLDEGIAAVHLVLEVDAQGVRLLEWAEGCEPRQDGQAQVAGAILQALAGQTCGPLRWAFCDPQRSFPERFPEAEVQTAPVRRKSSARAGGAWLLGVSLALALCLLGMLVEPWSARQHGMAGEEPQAKVRAYLREQGMSEVDVQRQGDSLLLGGYLEDNARRLALQRYLDGSGVDYRLEARSMEDIRQGVDFILQKFGYRQILSSNADKPGWVRLNGELAEQDERWARIDALLESEVPGLLGVENQVRVAGSHLRRLERLLADAGLDRQLSFRERGERIELSGTLDEVQLSAFYRLQREFQQEFGNRPSLELLSRGKRASGDELEFTIRSVSLGRVPYVVLGDGQKYPVGASTSRGVRILAIEPESILVARGKQRFIINLKGEVLHDDSLGNATVGR

SEQ ID NO: 30064 - protein, 141 aa, Pseudomonas aeruginosa
RHACRSAPAASAGGAGGVSPGTGQRRRPGALPVPATAGPGPRRRSRHSFAAHRGLSMAQIFNPNPGNTLDTVANALKEQANAANKDVNEAIKALQGTDNADNPALLAELQHKINKWSVIYNINSTVTRALRDLMQGILQKI

SEQ ID NO: 30065 - protein, 327 aa, Pseudomonas aeruginosa
SGFPAWPTRGAIRKPWPSPMAIPGRRWSPGSPCASGTWGWAPRWTAGWPGWAAAAILPWPTSPPACAPRCGHEPHRHAAGIRRLSVGQSKGGEPAGCRSGAGFRAGPRRRAAGGRTPPGRVGERRSRRAPAAALCPAAARVGGGPPGAEGDAPCGTAAGTPAANLSPPVARCSRACAGRRIPGATGASRIAGADPAQRHARQPRAQQPQTRPGVMMDISRMGAQAQITSLEELSGGPAGAAHVAEFERAMGGAGSLGGDLLSELGQIRERFSQAKQELQVELSTPGDDPNSLMQMQWSLMRITMQEELIAKTVGRMSQNVETLMKTQ

SEQ ID NO: 30066 - protein, 228 aa, Pseudomonas aeruginosa
TTASKDSATTASAWCWCRRPGSARSRWRHASRVSSRSRWRSTRADACSACSACCWRCCWRATWRSSSGTGNGAERRDAIDGLPVALLPGPLHPRVAPARGIAAVAAGAAGLAATERSQRLAAGATGIGLRVPHARATGRAGPLPAGGAGTDPGLARRAAARPGLAAGAGRCAGTAHPRADRRTGPAFLPGAARPAHRSLAARLAAGLAGKPGRRLFPALRPGFLAGRL

SEQ ID NO: 30067 - protein, 214 aa, Pseudomonas aeruginosa
MLPFVELDASRVRLAPGQALLRARDYQDYLSANRLVEAARERAAEIEREAHEVYQEQKRLGWEAGLEEARLRQAGLIQETLLRCNRYYRQVDRQLGEVVLQAVRKVLRHYDAVELTLAATREALALVSNQKQVILHVQPEQLAAVREQVARVLKDFPEVGYLEVVGDARLDQGGCILETEIGIIDASLDSQLAALQAALTESVARSGEEEGDAG

SEQ ID NO: 30068 - protein, 472 aa, Pseudomonas aeruginosa
GNQAPPPARALAPGRGLRRCRSPAAATLAVRSAPSEQGEAAAFGLRRIQADEDLELARLGRVPELAVVELQVCLAEAEDDLPRFAGLQHHLAEPAQFLHRTAEAGDRVLQIKLDHRGAGALAAVAERDPRFQGSAAGQPFAGQAQGRETELGVAEAVAERVERAVGFVEIARGVFAGVVVVHRPAGVQVVVVDRYLAHRAREGHGQLAAGVVLAEQHVGDGIAAFGATEPGFQDRIGVFLLPAQRQRSAVHQHQHQRLAGGLQCLQQPPLAGRDAQVGATGGLVGHALRFADHGDHQVGVARGAQGLLEHRLGGARIDLDFRVVAVQVVEDRLVATDVGTLGVEQGGTLADGIGQALVDGYRLAWHAGCRPTADDVALALGQGADHGDPPLFLQRQQTVAVLQQDQSFASHLAGGLAVQAALGVGVERRVVRLAQAPVGIGEQAEVVLHRQHVAAGAIDVGLVDLAGRQQLR

SEQ ID NO: 30069 - protein, 272 aa, Pseudomonas aeruginosa
PGRVEIVVHVHVDTGLDRQARGVPLVAGEAVLDQFLHRAVVTDGQPLEAPLLAQQVGQQPAVGGGGHAVDGVQRDHHRAGAGVHRGLVGRQVVLEHARQAHVHGVVVAAAFGRAVQGEVLDRRHDAVRGGQVGALVGTDHHAGQQRGQVGVFAEAFRDPPPARVAGDVDHRREAHVEPVGAGFEGGDPRAAGDHLGVPAGGQAEADGEDGAVAVGHVVGMEQRDLQAAMADLILHGANVRAGHGIEDGADLAGADVRHQRFLGMVGADADQA

SEQ ID NO: 30070 - protein, 121 aa, Pseudomonas aeruginosa
MSRQEVRLMEKPFSDDVSVNVLRRMKEGGFDFARIHPIDFFAIFPSEREARQAAGQFRGESLRAQVVARDDGSWNLQVSKVMYATHAAIGAFEHDLEEVVVPLGGVLDGWGVTQEVTSLRP

SEQ ID NO: 30071 - protein, 296 aa, Pseudomonas aeruginosa
RRRDPGRDPGPGLLRRAFLPRRLSFRLGKEVSHERYSDPDPCRVLSARPSGCRAGGARPGLPRDPRRPRRTRRSRRRTPASGGDHGWADERQRRPALVARRTGAAASLHRAAHPADRPLPRRPVAGPRPGRDGAAPALHRNGLAAHAAGKPRQSMAGRAAGALLDLPVAWRCLRPAAGRRAPAVQPVVREPGVFLGWSRTRPARPSGNDRGTGAALDRRLAAPARSLPAQPAIRRGHAGRVACQDCRAESGGRGFLPSLAVADRLTFPAAGAPLALPPVRFIARSSETAVCMEGRG

SEQ ID NO: 30072 - protein, 612 aa, Pseudomonas aeruginosa
PGWRCAKARWWSIRPRAAAPRTPGWWRNKHAQPDRFRPVLDVALPGTRGEPRPHARRQLLAVAVAAGPQRRRPGRTGHAAADHRHPRRLPGAPRRTGRRAPAEFLRPRPGQPGEHLQLPGRSARQCPCGTRADHPGHVGEHQRHLAGNARHRRRGHPALWHQSFLRMGEGPLAPVPRRDLRHQHAQRCVPLHPSRNLHRTRRQYLAPARCALPDPGRSGARRGGRGHRARLLPVERAAAGAIRLRGLHRAVPRLAQRAQHRRIAAVARGRAAFAAVLHRGTERDPFRPARRQRPAGAAPGRRAGGAGALHRHRRGAGAGPAYLDHRLHPAGSPVGQRHSQLLPGGRMRLSITHDTTYRYEDRVRASIQYLRLTPQDSERQHVVDWRLDLPRPARPLRDPYGNILHVLTLDEPHESVLIAAHGLVEIDEEREVEHDRQSPLPFLRSTRLTGADAEMRAFAERAMGGRKDRGGLLDLMHALHEHILYQPGATRVDSTAIEAFGARAGVCQDHAHAFLACIRSQGVPGRYVSGYLYTEDDTHLASHAWAEAWLGDGWYSFDVTNRLGRPERHLKLAVGLDYLDACPVRGLRRGGGCEQMHARVLVSAPLLQVQQQ

SEQ ID NO: 30073 - protein, 247 aa, Pseudomonas aeruginosa
GRFEMTYCVAMHLADGLVFASDSRTNAGIDHIATFRKLFTFGTPGERLLVVQTAGNLATSQSVINLLQQRIRRDGASLLNVPSVYDATALVAETTREVLARDGGNLAGNTDLSCSFLVGGQIAGGPPALYSIYPQGNFIQATPDTPFLQLGESKYGKPILDRNLTFDTPLEQALRCALVSFDSTIRSNLSVGMPLDLLVYHRDSLILPEGYRVTEDDAYFSAIRRQWSAGLHDLLERLPSPPSAYNI

SEQ ID NO: 30074 - protein, 732 aa, Pseudomonas aeruginosa
AAAWASPPSSSACEGRTGMTDAIRYEKGQDNVVVLTMDMPGQSANTMNGVYREAMAKTIARLEAEKEGIAGVVLTSAKKTFFAGGDLNELIKVTKADAPAFYQGILELKGQLRRLETLGKPVVAAINGAALGGGWEICLACHHRIALDNPGVQLGLPEVTLGLLPGGGGIVRMVRLLGLEKALPYLAEGKKVRPAEALKAGLIHELADSPEEMLEKARAWILANPAAKQPWDSAGYKIPGGTPASPNVAQMLAIAPSVLRDKTKGCFPAPEKIMCAAVEGAQVDFDTAQLIEARYFTELTTGQVAKNMIGTFWFQLNEINAGKSRPQGYPVRATKKVGVLGAGMMGAGIAYVSAAAGIEVVLKDVSLEAAEKGKAYSARLLDKKVARGHLSAEKRDAFLARIVPSVSEADFEGCDLIIEAVFEDRALKGKVTAEAEKHALADAVVASNTSTLPITGLAQAVARPEKFIGLHFFSPVDKMPLVEIIRGEKTSDETLARGFDYVLQIKKTPIVVNDSRGFFTSRVFGTFTNEGIAMLGEGVSAAMIDNQARQAGMPVGPLAISDEVSLSLMTHIRNQTARDLEAEGKALPTHPAFAVIDLMVNEYKRPGKAAGAGFYDYPANGRKHLWAELKSRFEKPDAQISAEDVRDRLLFIQAIETVRCVEEGVLHSTADANIGSIFGIGFAAWSGGALQFINQYGLKDFIARAQYLVEQYGERFEPPALLLEKAAKGELF

SEQ ID NO: 30075 - protein, 246 aa, Pseudomonas aeruginosa
HQARVVEDQRSAHGHRKRFRALAELPFVKLSGRHLAPADATVAEQFLRATRPALPSEVGRGGDDGQAQVRADPHGAHAVLEVFAEADAGVETGFDDIGETLVRHHFQGDAGIVAGQFAETWREDETDGVSRCVDSYQAVRRFAKAVKAVQRGGDVFERRVQVCQQVLAGLGRRDVASGAVEQADAELGFQFAQGVAERRRGHAEGGGGAAETAFASDGDEGGETGEIGLFHWIIKITRSVKEIFPG

SEQ ID NO: 30076 - protein, 341 aa, Pseudomonas aeruginosa
TGWTGETALFRAFRRGRTMQHVRLGNSGLKVSRLCLGCMTYGDPAWRPWVLDEERARPFIREALEAGIDFFDSADIYSTGESERILGRALRDFAQREDLVIATKAFFPMSDRPNACGLSRKHLLASVDASLRRLGTDYLDLFVIHRFDPETPIEETCETLDSLVRAGKVRYLGASSMPAWRFMKMLAFQRHHGLAQFISMQSQYNLIVREDEEDLVPLCREEGIALTPWSPLARGLLAGARSAGTLRTRTDEQAPRWYGGREEVESTLGALEKLAAARGLPPAQLALAWLLGRNGVAAPIVGLSRPHHLEDALAALTLDLAEEECATLEAPLTVRARTPRW

SEQ ID NO: 30077 - protein, 215 aa, Pseudomonas aeruginosa
GAHRRRKHDETTGFRVAAGIHGIGDRLAGFRPCAGRARAVLRRDEHRPASGGPVSQRHRPCRRWNAVRRSGHQRAHPAQASRGRVGILLRRQPGDLRCHRAAAGRAAWPALGQFAGLPTRWPAPAAWGVRPGSRDRCRAPISDPARRRDGQRSRGGAGRNGLPERNPGWQPDAAAARGTGVPGVAARQPPGRPRRPGRGGHRPGGRRHPAGRQLR

SEQ ID NO: 30078 - protein, 546 aa, Pseudomonas aeruginosa
RGDPCRRRGRHASAAARDGAAPNAGESGRHGAGSGRLADRAGERHPQRRRQGAADRRAARSRAARHRSDTRGPGVAGQPDRHRTGLRLCQRVPHSPPPVAGARGRGAGAFPDPPAAPGRGRGPLIGRSGVGETTFQIGDDLAGFVHPAHLAVFLDAQARHLDLPAAFQQSLAGLRIVHGVLELHRQVQPVHGAACLHAERTGAELVERQVPQRPLDLGLGLGAALQLAGAADEVGEDNRLTQSVTYCLEQHGVCLAGKPPVYVAVPGMGSPSVSCADFFTAGRLGNLSAGCLFFGESSGYSFRGQGDGSLARAPVLIKSNENDNNPTSSESLYVAPHLYPGNRYPSSRADRALRRLRPDVPATVRQATDRRRIRHLQRGGGALSGGRRALRRLPGDRQQGRLLRSRPVDPDPEDLPPGPLRARRQAPRRVFRPPVAGPAARWQGRARQPGLGHGHPPVPVERTGRLDEPGAAGPDPVDQPPGPGHPAAGKRAGDRFQRLLSLCRLRHRRPGAVLPGASRVRPRLLPRTARTTPAAPGRGTLSQGGR

SEQ ID NO: 30079 - protein, 186 aa, Pseudomonas aeruginosa
KMQGGARSACPEAKKETLMIREVEGDILLSGAQVIAHGIAPQDHFDSGLALALRERWPSMVRDYRHAAHARAPEPGGIWVWAGVDEQGKTQCIVNLITQGMLHSGRSAKPGKASLEDVGHALRELARYVRSEGVSSLALPCVATGVGGLDWSEVKPLVVRHLGDLEIPVILYEVYRKGVAAEEKLA

SEQ ID NO: 30080 - protein, 169 aa, Pseudomonas aeruginosa
VWPGKTAIWALSLVRPCMRCRSPVSRMSARRAQPPGRERTKLSGGLLKAGTRGHPREEPYQSGAGRVTNPLRRSKVSESLSIHHDVGGHQFETTVDGHRAYLAYMDLGKQTLDIYRTFVPDSLRGRGIAAALTEHALQYADRMGYSVIPSCSYVERYIERRQRQADPAA

SEQ ID NO: 30081 - protein, 369 aa, Pseudomonas aeruginosa
KTPGISPAFSFPPRSAALAFRQHVLELGVHAADALLGGRPVDACIGDGDAVLKLVEILRNRLAAPAQVAFHHQADDRVVAFDDLVADVVHHQRLQGRVLVGVGVAAVDHDVQRDFRLVQVLLAERDADRIVVRLAVAAAQHHVTIAVALGGDDGYAALLVDAEEAMRAGDRLQGIDRHGQAAIGAVLEADRGRQAGGHLAVGLRFGGTGADRRPADQVLQVLRGNRVERFGGGGQAFLGEVAEQLATDVQAILDLERVVQVRIVDQAFPAHRGTRLLEVHAHHQEQRIRHFGRERLEAVGVFVGGLDVVDGAGADHHEQTVVLAIQDVAHHLATMGHGLQGLVGQGNFTLELLRRDQGLVGGNVKVVDL

SEQ ID NO: 30082 - protein, 195 aa, Pseudomonas aeruginosa
CGAWLPAPGAGPGLPFGAGHAALRLVAGGRQDHRQSRTGTPDPRSGGAGSQGSAAAERSGRGGAAAAAAAGKPASAGRPLLHLCASRRTGRDRAPGLRRSESRLSFRTGRRATPARDRRGGCRAVPRVRAGVHGDARPGAGALAEAGLEHPLQRAVGIAEEQHRAADGQRGQSVADRGDHGGSHRCCRRLRLHPA

SEQ ID NO: 30083 - protein, 344 aa, Pseudomonas aeruginosa
YGYIPSVLDRRSRQPFRGISMKLQQLRYIWEVAHHDLNVSATAQSLYTSQPGISKQIRLLEDELGVEVFARSGKHLTRVTPAGERIIHTAGEILRKVESIKQIAQEFSNEKKGTLSIATTHTQARYALPNVISGFIKQYPDVSLHMHQGTPMQIAEMAADGTVDFAIATEALELFGDLIMMPCYRWNRCVIVPHGHPLTKLPKLTLEALAEQPIVTYVFGFTGRSKLDEAFSQRGLVPKVVFTAADADVIKTYVRLGLGVGIVAHMAVDPKLDNDLVILDASHLFESSVTKIGFRRGTFLRGFMCDFIEKFAPHLTRELLAKAVQCHNKAELDELFDGIELPVY

SEQ ID NO: 30084 - protein, 195 aa, Pseudomonas aeruginosa
QPGHLHRPQPPGAVRTARAGPGPGHAFAAGAEPGYLAGQGTVAGNRPRGAAPRLRGNPRIPRAQRSLSGRALPEGALWPDRRLGGGRASRQPVAAPATAGAGNGPARRRQAGGQRLSAGGGLRTLAWRPAGSAAGPWRCQPIERRPGQRPDRAPGRPGAAGAPGVHAIVPPAAGSRTPVVSLPPAVRRLPPQPPA

SEQ ID NO: 30085 - protein, 1466 aa, Pseudomonas aeruginosa
LRSGPFQATAFQRQPVVHQPPHADVRHRACLCGGRPGDDRRAGRRMRTGTDQPRPAQPDLPLAQACAGRNRRALSDPGPYRCLVAGQRPQPGRGQPDHRRTAGALGGEPRRRADGRPVPLRAGGEGGGGVAEGRSGTVHRPGSPGRSPARAERCLPRSGGVDHRRAGPGGPWPGRPGAAPAGAGAAAQSFPRRALPGHATGQRRGDPRTRAGPGETGATAHRAAPPARPAAVREVQERAGAADHHRGPDRLLQDRAGRAGRAPGLGARACGCDQSDRFLCPGTDLPGAHPAPAGTAEGGAGQPGGDAGPGLAQSVVALLRPGHGRRDQPDPPGQRPRPPEARRAAVEERGLEQDGGTLPQHGLQPGQLVAGREPRAPVAGARTFQRGAARDHSVARHLAARLARPAAPAPGYPGGAQLSAPGLPGTGQQPARRMPDQCRTGRGAQPLHRGRRRHSPVAPATRIHRAPAGATDLHSRPARHLARAGRAQAPGCARGRPDGARARSGLPGRTGPIQRRNRPAPVAGPGDRQMASAQHLRKAQGAQSHPGDPASPRAEPALTMGHRDGVPASTIPLLQTKLFPPGAGGLPLLPRQALIDRLYEARGRRAMVLSAPAGFGKSTILCQLRLRLLEQGAAVAWLSCDETDSEPQRLIQYLLASIQRVVPAFGGNTANLLGTDVAVPLEGILDAFLADLRRLEGPLYLFLDDFHRIRHAALPHGVRYLIENLPDHVRVVASTRFRPRFLVDEPTLKPWTFCLSAEDLRLSREESDAFLLDLKGLELGERELKLLFKRTEGWITALHLAALALSRNTDREGFLRGLSGTERNIADYLAEDVLASLPADLQLFLDQTSVLDEFNAELCNALTGRRDGLDMLMRLQNEQLFVIALDDQREWFRYHHLFAEFLQGRLSRHADPTPLLHAAARWCEGRDLADRAIKYALRARDYLFAAELLERQGARLIAGNRVYGILGMLNGIPAEVIREHPVFQIFYAWQLAFEQRFAEAEALIEEVSHRLLQGRGKVMHFGLGELLAAAQVLKALVLLYQDKLEACLKVARHWLSMVPSNQPVFRASLLCVQASAHALLGDYAEAAGAIGSAREDLKVADSEYLQVVTSLIESLICKESGDLERGRAIAESARNRVEQVFGRRSRVGGPLSLAYADLLYEQDRHAGVLAELPLATVWRDVATPVELLSRGQLVMAKARFFSGAAEQGLAQLDEWLSGLLSPGYERVYAHAMSCKVQFLLWLRRPNEAERVCLQLERHLAGLSGERHADAQTALVLAEARLALSERHAERAQSKLESCLAGYSSAYQRDRRLRLSLLLSVAYWQKGNSEKAIGLFLATLEEAWNLGYRRLFQDDALWLLPMWESWREAEPKRAAAWQGLADLLREQCRKLSVDPESFDENQDVSHREREILRLVAAGLSNRDIAQAVHLSEATIKWHLHNLFAKLGVKSRTQAVLKGKSLGLLSEA

SEQ ID NO: 30086 - protein, 182 aa, Pseudomonas aeruginosa
GSSTGPGDRRDAGRSAGDRMQTAVPWGKPHLNTGEITMKKHLFLATAVLAAPLLAHADLKAMDDGALSDVTGQAGISISGTFQGSVGAVTYTDTDTNGGSLRLENISLPALTIDDTKPLTIDVVTTDIGGKSTQQLAIGLPAITGDVTVGAIKVGDTSAASIGSLTVSGLNMAGSTIKVWGH

SEQ ID NO: 30087 - protein, 279 aa, Pseudomonas aeruginosa
SRNRVETRRPRRGIGGVFLRKRYDGAMFEILLGSLIGLFGFTQTVDTKPQPQGTVNLSQPLTPNGPYRESVQLEPMSQLQFRNVIRQAYDYSCGSAALTTLLDYYLGRNLEERQVMEGLLRYGEADKIVQRRGFSLLDMKRYAAALGYKSGGFRAEFSDLDALEHPALVPIHYAGFKHFVVVRDVYNDHVFVADPALGNISFTRTRFEEIWDQNVLFVIFPSGQEPRNALALNDRDMRLVDDRTVSLLAFREFPQINKITENQVRELGTGGDVIHLRTK

SEQ ID NO: 30088 - protein, 406 aa, Pseudomonas aeruginosa
PTVRPSEGWSMMRASIVLCVFSLALPASSPGWASGGRYLTWVDDNGGVHNTFVDGQFDRQQRQARQRIGQSDQARVLNKADNATQWPGNSSGGESKRRYYTWIDANGNVQNSFYAGAQVAGQRADYVLPNGEHSAEYIDAEAFEGKGFVRSENGSPYYTWVDEKGRMHNSQIPLEERAARFKREAAPSSQIAFTEGRQIEFKQRPAALPGLDGAGQQSDALKALLKGTEMTIDDLYQDLQRRCCEQIAESDFTELDADEPRYEELNRFSPSFDFPMGRSFYAAIRLPRSQGVYGLRIRSFANRQVVYPSLLFLDEHKRPTRLVSDAVYKLNPETWYRYAFIEGTVPVRANRGERYVLLLTTDEDRSLQTLDNKPFKRPLQGLAVNEAGMQVHEHARQGGFELAVVR

SEQ ID NO: 30089 - protein, 306 aa, Pseudomonas aeruginosa
NEIPSRGSKRYRKRARDLGGAEPLAPERLFEAPFHAFFDEDLCGNLLHREMRGVDVGDVFAAEQAFDLAYLEFALGEAGVATVGLALVANRGEAIGVDGQAEQLVLVLLEGVRQLQALHVLFRQRVVGGADAILQGHVQAGGRLAAARDADQDQVGLVVVVGAGAVVVVEGEVHRLDAIHVVGVVADGVGLADRIGRVGRKLLFQRRKKGGEDIDHETVGLRQDRPDVAVHDGIEDDRAGPVRLGSIIDLLYHGARFFFGIDVRSRQFDEADVLELCQKALAQGFGGDTGAVRDEECGSFHLHRKP

SEQ ID NO: 30090 - protein, 816 aa, Pseudomonas aeruginosa
GPGQNPAELLLAPLELFQFNSGEITLVEYVVSLDKLGVHDVEHVGGKNASLGEMISNLAGAGVSVPGGFATTAQAYRDFLEQSGLNDRIHAALDALDVDDVNALAKTGAQIRQWVMEAEFPARLDSEIRQAFAALANGNDNLAVAVRSSATAEDLPDASFAGQQETFLNIRGVDNVIRAAKEVFASLFNDRAIAYRVHQGFDHKLVALSAGVQRMVRSETGTAGVMFTLDTESGFRDVVFITGAYGLGETVVQGAVNPDEFYVHKPTLEAGRPAILRRNLGSKAIKMIYGDEAKAGRSVKVVDVDRADRARFALSDAEVTELAKQAMIIEKHYGRPMDIEWAKDGDDGKLYIVQARPETVKSRASATVMERYLLKEKGTVLVEGRAIGQRIGAGPVKVINDVSEMDKVQPGDVLVSDMTDPDWEPVMKRASAIVTNRGGRTCHAAIIARELGIPAVVGCGNATQILQDGQGVTVSCAEGDTGFIFEGELGFDVRKNSVDAMPDLPFKIMMNVGNPDRAFDFAQLPNEGVGLARLEFIINRMIGVHPKALLNFAGLPADIKESVEKRIAGYPDPVGFYVEKLVEGISTLAAAFWPKKVIVRLSDFKSNEYANLIGGKLYEPEEENPMLGFRGASRYISESFRDCFELECRALKKVRNEMGLTNVEIMVPFVRTLGEASQVVELLAGNGLKRGENGLKVIMMCELPSNALLADEFLEFFDGFSIGSNDLTQLTLGLDRDSGIVAHLFDERNPAVKKLLANAIAACNKAGKYIGICGQGPSDHPDLARWLMEQGIESVSLNPDSVLDTWFFLAEGQDQA

SEQ ID NO: 30091 - protein, 348 aa, Pseudomonas aeruginosa
HRPFSCLLYKTSMQSSSRLFPVALVSAELRADLTEDIYRLKPGNSPDASVELVVTRLGQQAAGERRGPPVILLHGSFSNRRFWYSPRALGLGPYLARAGFDVWLPEMRGHGLSIRNDGYRDNRVADYARYDLPALASFIHEQCGQPAHWIGHSLGGVVLAAGLGGGYLDQARIASVALFGSQVSTAHWLFRLPMAGILARLLLRRVDALSGSRWRQGPEDEPVGLALEVLRWHGLFGRFGEPGNDWWKGLAAVDVPLLAVAGAGDRQDPSWACRKLFEQFASSEREYLLLGREAGYAEDYGHIEMLIGKAAQLEVWPLVERWLRQRSPAGDESAWSEALDVSEAGISG

SEQ ID NO: 30092 - protein, 264 aa, Pseudomonas aeruginosa
SASTTVRRIWRRFPVFPRKTHLLLTRLSEHAIRYLDPELADRDEHPVGQAGRLHPQPARRPGGRSARLRHRQAARCAAFQAAGQAGPGPADGWHRPDQAAGPGRHPGSGLDAGRQDRLLVRTARLPRIRRRVARPAAGIRHAGRPRPVPAQGVRRGPGADRRRAPGATGEQRRARRGGRRRPRIRERPGADRPVAGHHHQHLGGGGAARGQDRPAQLHHRHRPDHRRPGRCAGPGPGQPRGRRADHCRNLRPRAVSGRTTGESG

SEQ ID NO: 30093 - protein, 198 aa, Pseudomonas aeruginosa
SHLNKPHPLSQRYDPRQLSDEELVERAHSELFHVTRAYEELMRRYQRTLFNVCARYLGNDRDADDVCQEVMLKVLYGLKNFEGKSKFKTWLYSITYNECITQYRKERRKRRLMDALSLDPLEEASEEKSPKVEERGGLDRWLVHVNPIDREILVLRFVAELEFQEIADIMHMGLSATKMRYKRALDRLREKFSDATET

SEQ ID NO: 30094 - protein, 351 aa, Pseudomonas aeruginosa
RMKLKNTLGVVIGSLVAASAMNAFAQGQNSVEIEAFGKRYFTDSVRNMKNADLYGGSIGYFLTDDVELALSYGEYHDVRGTYETGNKKVHGNLTSLDAIYHFGTPGVGLRPYVSAGLAHQNITNINSDSQGRQQMTMANIGAGLKYYFTENFFAKASLDGQYGLEKRDNGHQGEWMAGLGVGFNFGGSKAAPAPEPVADVCSDSDNDGVCDNVDKCPDTPANVTVDANGCPAVAEVVRVQLDVKFDFDKSKVKENSYADIKNLADFMKQYPSTSTTVEGHTDSVGTDAYNQKLSERRANAVRDVLVNEYGVEGGRVNAVGYGESRPVADNATAEGRAINRRVEAEVEAEAK

SEQ ID NO: 30095 - protein, 215 aa, Pseudomonas aeruginosa
VSGMPQAVAPASPAVMPFTISLSIPCRASHSASSPARPKMHGSPPFRRTTLRPWRACRSIRRWMKSCGVERQPPRLPTRTSRADGQCSSMLGLTRSSTITTSASCRARTAFRVNSSGSPGTRTHQPDLTAHRRSPQAFAAMGPGGRQQSLDFRYAGAAAGAAAELALQSVQVQSAGDAAEHRLLADVLATAQGLAARTLAGSSRCRAEWGEQPAA

SEQ ID NO: 30096 - protein, 889 aa, Pseudomonas aeruginosa
LAIGPAGKPELFQPVSGEGFAGEPDGDDAPVFEAHALADGAPWVVVGEDRPVEQFELAIYPLQQVCARCLMVCGADQQGGALASGETEAGVVEDFAQRTEGLETRLDIGFHQREQAPGQFDGFDLNPGVLEFGLFRQGVERRQGQDIAAQALEEAIAPVHRQEGLAGAHRVVCTHWQDQGATPALQAHELPVLQLAAAQFLGMQVHQGLLFMAEQACAGAGPAHAVPLVAQASGIEGQRVARVTFFLGGAVGFGDQLRASRGGREAAVCIEPCGALLRASGKWPLLRPQAVEQCVAEAGKIEVAAGGKQLVFVEQAAAVGKGEQAGFSGTQVPFQAAREVADDVPVLARFTGGRNGPTDMTDPPFRIGHGAFLFSPGCGWKQKVGVLAGFRAGEGFLDHHEGTAGKGLVDLALVRQRLRGVGTGDPKRLDPAVVDRIEQLDGAETGGRGQLFHTPVVRHLGAMAGIGGFAVAGQQVGQAAGLATAHGVRLAGEGKRPASGAADLAGSQVQVDQRAVLGAAGAGLVEPHAPERKEARRTADPFGAALQVGAVDAADVGDGGRGVVAHQFLQVGETLGMLGDERTVDPVLPEQDMQDAVEQCDVGAGQQRQVQVGQLAGVGAPRVDHHDAHLRPSGLGGFQATEQDRVGEGHVAAGDQHAIGAVEVFVAARRCVGAQAALVADHRRGHAQARIAVDVVGADQGPRQLVEGVVVLGQQLAGDIEGHAVRPMFANGLGETPGGMFQGTLPVAASPRQLLAEAQLGVQRAGLEVAGQVQAGAFAAESAEVGRVPRIALHAEDAFAVVFDQDATTHAAVAAGRSGGAQRGICRHARLLLSARDQAHSATLSRPSSTRPFSTRTGWRWAQPWSGATASPLSSSICQLCNGQATRLP

SEQ ID NO: 30097 - protein, 831 aa, Pseudomonas aeruginosa
GEGRRGTARTRDSDVFQLLERNPFELLLQLRLFDALLPWVLLEGQGELQAVVERLAVFRVLDHRLADVLHADPLQVMHRALQIEGFLAVELEEGAVVFAHLFGGLELDEELRDLGLDPAVAADVHLPAGVHADDADVLDPGLGAVARAAGDRQLDLVRRPHVEQVVFQIDAQLRRVLRAEAAELAADAGLHGADGFAVGMSGGHVEVFPDGRQVVLLHPQQVDALATGDLDHRHLVLVGDVGDAPQLGGVGHATPHPRYHRVGAVLLDVGVGAFVDQARLRIVLGFSRPGRDQVVVQGRTAGGTAVRGLPVHEAHGGVETGQPVFANGLADLPVVEVAAAADGLLALRLDVGGAADGADQDLFHQSRAGATGAGGLGVFLDFVDAEQAVFLYGLDDGALADAVAAAYFGRVGHARGAVLALVADIAEGVLAEHQVVADLRDVVVLADLPEVPAAVGGVAVETGADQYIVLDHQLLVDAADGVGKGDGFAAFAADEVAGGEQVDTGHLELGRGHRALVAGVAEMSQVVGADLGLLEQRRNQAVGDATVVGAFADRIDAWVVGLQGVVDQDAAVAGDARAFGQLGIGADAGGHYHQVGGNHVAVVELHGTDPAAAVVHQFLGLGVQAEADAAGFQRALQEFAGGAVQLAFQQPVGEVHDGHVHAALLEAVGRLQAEQAAADHHRVAVGPGAVDHGLGVGDVAVADHALQAIAGYRQDEGERAGGQQQAVVLGLAAVRGDHPAADPVDLHHLAVEEELDAVFRIPVEVVEDDFLEGLLAGQHRGQQDAVVVGMGLGAEHRDVVEVRVELEQFFQGTDPGHAVADHHQLDLLHAE

SEQ ID NO: 30098 - protein, 408 aa, Pseudomonas aeruginosa
  UNSURE (59): Identity of amino acid at the above locations are unknown.
PAVLRQQQAVQGLHDGPGFRSRIVIQGQRLQAAARRQAAIGALADTVGDGQQVSLAGGXGRRRGDHPQRILVFRARPAGAGLANAQSQPHAQTRAAVTAAEPPGGAPAPLHPVEAEPGQHAETGEQPQAELVVAGALLDRAEAGSQAEAADAAGHADQPGHHADFLVEALRYQLEHRAIAGTETEHGDHEQAEGGHRAGQVETDRGDADGGQGVHHQQAADAADAIGEGATERAHQAAGEDAGGGVVAGGHRVQAVLVVEIAGQGAGQAEEAAEGDAVEEHEPPAVAVAEGFQVIAHGLGRRPLRGVARDHGEHQEGQDERQQGEAEHVVPAERGGQAGGEEGGEHGAGVARAGDAHGLALVLRRVPLRCERQGHGEGCPGEAEEQPQQQCLLIAVHAQQPGGREGGR

SEQ ID NO: 30099 - protein, 427 aa, Pseudomonas aeruginosa
SSGRNRETPRTGSAHGRPSRSCCSSNTSYPAESGRNGRPAEVASLQGERPTADHPPAPTLGRNDEDATGLCREGEAARRLCRGWVTAVGYRQAGRSKLFAKLSKARRRAVAGTTMASGVHAAVAGVGGLHRAGAARPCAVGGSAMGGVQVVDGHAAAFAAVAGVVVHVGAGLEIEQLVVPGAAEGLVVSVLFAVLAACAHRQLAAGGDAQAVVEALAQAYLLEDRHVAAIGIVRVVAYQRLDPAEAFLGLVVVLQLHQRFAVVGLWRLAVDLADDHLVLRGDLLDAHGHPQFVVGLPVVPVVEAAVGLGFAQFGARIGAVLGVRAVDGHPEDQAAIVALLEVPALVAVVELLGGDHLRGGFGGNGKVPGAEIDHAEHLLTAESAVRFGRTPAAPSPGRPLRASLVMLVEGGEGVAPRTDRAVPGARA

SEQ ID NO: 30100 - protein, 248 aa, Pseudomonas aeruginosa
PKGRRGIAVQRGLLDPAGDAQVVRVFAQQAPAAELGHEPHAIREPGPVDFAVGVETQRMWVLPGVAEAVLVAAEEARLDRAERSVDIVAAADQLRGAQAVLGVLFDEAAGVEDRHDQRAGGVRVGVDEGAGSAEDLFRVVRPDRLAGGDGEALALVHGQGAPGAAGAEPVDAPGLEMADHLRRWNHHTVHVVQRMQTDAREPSSSARARGYRWGKVCPRVRRAPFWRRCRSSASRTGHASLLQAVRKD

SEQ ID NO: 30101 - protein, 225 aa, Pseudomonas aeruginosa
NRCPGRSFPVRRNRRPRPGCVSLCLSSPPQVREGGAGRPVFQCAGAVVGALFHSCHSKRYARRRGGFRRARKSPARGGACSTRRWIRPGRPGSWRSQPLRGTRRSGRSSGSGRRRQPCCRCPSRRPCTPPRSAVCRGSRRPPPARPMPGTHRWHRPDGSGSYGSKWRPRWNRSGREPGCPCTASSPAFPCARQPCRRCRSSLPRSAGGRPSWSAEPATDGSGCRP

SEQ ID NO: 30102 - protein, 276 aa, Pseudomonas aeruginosa
MRVPPSATWRRDWAMERWKASMPSSPIQASKKSPRMYRASARRARSSRKDRNARVMSGRSASRCRSEMNRTLIASFFDDFGLLDDHVLGRHVLVAAAHGGGHALDLVDHVHALDHFAEDGIAPALGGGGGMVEEIVVGDVDEELRAGRMRVHGTSHGDAADLVGQAVVGFVLDRCASGLLLHARLETAALDHEVVDHAVEDGVVVVAAFHVLLEVRRGFRGFLFIELQGDDAMVGMQLDHVGNPLCRENRRPVRGLTASAMISALICPAYPGRARA

SEQ ID NO: 30103 - protein, 222 aa, Pseudomonas aeruginosa
SRRAWRRGRRRTGRSPTGFAIGSPPWASCWRMARAALPGAWPTEPAAINEKPRERGAFHYRRPQSCRCSAACRVFSSRQARVIGPTPPGTGVIQLARCAATSYSTSPTRRPSAWRLMPTSMTMAPSLIHSPLTSPGLPAATTTRSARDTWSARSRVKRWVTVTVQPPSSNSRAMGRPTMFEAPTTTASMPYRSAPVLASRVMMPFGVQGRRRGMRWARRPML

SEQ ID NO: 30104 - protein, 75 aa, Pseudomonas aeruginosa
SDMSMKWTEQRLRKALKQMANNHESAAVEVMRAVERANDPKLAQRLLEVIEQMHQDADALRSIDDEIASGVIRCQ

SEQ ID NO: 30105 - protein, 259 aa, Pseudomonas aeruginosa
KIVKPPLSTGSLPGQAEGGASLRRFQRFRIAAVPLRDPADDRQAQAEAAGAAIAAVVQARKGFEDLLPGVRRYPGAVVVDPYLTAVALIEEGDFDARVCVANGVAQQVDHCARHEARLDADLFDLAGADLAGDSGGFGFQGDVGDDAIQPARGVDDFPVAPDVAVLQAGVGQQFGDHFLQFAEIGAHVLYQVVAYFGVDLLVQLLEFEGQAGDRRAQFVGYRVGQFTLVADQAFDAVGHLVEVLGQGADVGASENARAR

SEQ ID NO: 30106 - protein, 759 aa, Pseudomonas aeruginosa
QVEAQEQAQHSELPAQRVEQVALAPDGLDPDRLARIVLQFIAQLADADVDAAVQAVEADAADLVEDLVAGKYFPCLAGQQPEQLELHRGQFDAEAFEFRFAPPSVDVQLAECQAFRGGGKGRVPAHQGAQAGEQHRWLDRLDHVVVGAGLQAEDVIEIVLLGGEYEDRQVRDPADLPAHLQTILSGEHEVENHHLRFEVEESGERGITAMHLAHFETMLGKETGDQAGELLVVFDEQYLAEGRAVHRVSSVGAESAGIICARFRRSSSDSFEIGLRSAEAAGNTPGIRLHPGGVTSAFPSTRMHALDSGSRKDRLTSVQRGISMQVSVESTSALERRMTVGVPAERIETEVNKRLQQTARRAKIPGFRPGKVPMSVIRQRYEASARQEAMGDLIQETFYEAVVEQKLNPAGSPSVEPKSFEKGKDLEYIATFEVFPEFTVSGLEDIKVERLQAEVSDADVDNMLDVLRKQNTRFEVVERAAQNDDQLNIDFVGKIDGEAFAGGSAKGTLLVLGSGRMIAGFEEGLVGAKAGEERVLNLTFPEDYQNLDLANKAAEFTVTVNSVAEPKLPELNEEFFALFGVKETGLDGFRAEVQKNMERELRQAIKSKVKNQVMEGLLQANPIEVPKALIGNEVNRLRVQAVQQFGGNIKPDQLPAELFEEQAKRRVVLGLIVAEVVKQHELKADEGRVREMIEEMASAYQEPEQVVAWYFKNEPQLNEVRSVVLEEQVVDTVLQKATVTDKQVSYEEAVKPAEAPQAA

SEQ ID NO: 30107 - protein, 216 aa, Pseudomonas aeruginosa
SQDMSRNSFIPHVPDIQAAGGLVPMVVEQSARGERAYDIYSRLLKERIIFLVGQVEDYMANLVVAQLLFLEAENPEKDIHLYINSPGGSVTAGMSIYDTMQFIKPNVSTTCIGQACSMGALLLAGGAAGKRYCLPHSRMMIHQPLGGFQGQASDIEIHAKEILFIKERLNQILAHHTGQPLDVIARDTDRDRFMSGDEAVKYGLIDKVMTQRDLAV

SEQ ID NO: 30108 - protein, 165 aa, Pseudomonas aeruginosa
RVCGSSPTSTSASMIACSCSASLPILWMRRPSPTISPTHMRGLRLPYGSWNTTCISRRSGRTSCCARPSSRVPSKRMPPWLSSSRRIARPRVDLPEPLSPTMPSVCPRGSSKLTPSTALTWSTVRRNTPLRIGNQTRRSSTANRVSPGGLLAGAPLGSALSSSRV

SEQ ID NO: 30109 - protein, 420 aa, Pseudomonas aeruginosa
GSRRRIEWAVTDLPEPLSPTRARVSPWRMSKLTPSTTRWRCSPERNSTARSRISRMFSLISFPRVESVAGGFADEHQQAQHDRQHHEGGNAQPGCLEVGLALGDQLAQRRRAGRQAEAEEVQGGEGADGAGEDERHEGQGRDHRVRQDVTEHDGAVAHAEGPGGADVFQVAPAEELGADHVHQAHPGKQQHDAQQPPEVRLDEAGQDDQQVEHRQPRPDFQETLAEQVDPAAVVALQGADGDADQRTEHGQGQGEEDRHAEAVDHPGEHVAGLVVGAQPVFRRRRGGGGNLQLVVDGVVAVGDRRPKHPAVLLGDQLADVGALVVGFQGEFAAEGGFRVAFEDREVPAAVVMHDQRFVVGDQFGAEAADEQDEEQPERPPATLVALEAGPAALVDGRQAHRITPGSRSRCADRPGCRRYR

SEQ ID NO: 30110 - protein, 348 aa, Pseudomonas aeruginosa
RALLEHGATGVHEQRLGLAGDLVRDFRADHIAAQNRGEAIVVQPVLRLVLDVEVELAGLEGFEGDAVVPVEVHHDPVEIVFAAVHRQFFAPPALHAFEHQAAPGIDLDDAIGTAAQRRGEGGGAEVAILPVMLRQHRKLAQAQDQQRVAGAPQDETHPVGGEDIDPLHLLQVGAVHRVPLLDQGAIGKGHVAGGDRPAVVEARFRPQVEYHPAAVFRVFHALRDQAIAGGWFVAGRVVQAGAHHQWFVQLVDSVLEEIAGADRAGAFQGVGVERVEAARGHQAQGAAFGGVGIGPVEVLEIGRILERAELGITMALGNRGEAGQAHGQAEDQEGEATHQACVRVLGYF

SEQ ID NO: 30111 - protein, 765 aa, Pseudomonas aeruginosa
ADRRGSPACCSGSTMYKDLKFPVLIVHRDIKADTVAGERVRGIAHELEQDGFSILSTASSAEGRIVASTHHGLACILVAAEGAGENQRLLQDVVELIRVARVRAPQLPIFALGEQVTIENAPAESMADLHQLRGILYLFEDTVPFLARQVARAARNYLAGLLPPFFRALVEHTAQSNYSWHTPGHGGGVAYRKSPVGQAFHQFFGENTLRSDLSVSVPELGSLLDHTGPLAEAEDRAARNFGADHTFFVINGTSTANKIVWHSMVGREDLVLVDRNCHKSILHSIIMTGAIPLYLTPERNELGIIGPIPLSEFSKESIAAKIAASPLARGREPKVKLAVVTNSTYDGLCYNAELIKQTLGDSVEVLHFDEAWYAYAAFHEFYDGRYGMGTSRSEEGPLVFATHSTHKMLAAFSQASMIHVQDGGTRKLDVARFNEAFMMHISTSPQYGIIASLDVASAMMEGPAGRSLIQETFDEALSFRRALANVRQNLDRNDWWFGVWQPEQVEGTDQVGTHDWVLEPSADWHGFGDIAEDYVLLDPIKVTLTTPGLSAGGKLSEQGIPAAIVSRFLWERGLVVEKTGLYSFLVLFSMGITKGKWSTLVTELLEFKRCYDANLPVLDVLPSVAQAGGKRYNGVGLRDLSDAMHASYRDNATAKAMKRMYTVLPEVAMRPSEAYDKLVRGEVEAVPIARLEGRIAAVMLVPYPPGIPLIMPGERFTEATRSILDYLEFARTFERAFPGFDSDVHGLQHQDGPSGRCYTVECIKE

SEQ ID NO: 30112 - protein, 350 aa, Pseudomonas aeruginosa
RHPDHAAVRQAHQRGDGGGQQEEERRLAVGRRYAGQVGAGIDRHRQGIEMLAAHVAGIQRLFHLGDVDGGDEYVVADRREQAVGDEQHARLAFRRQRQHRLDDRGEQVLLVDHRDHREEHHQQRSERQGLLEGAADLVFVGDAGEGSDQHDHQQADQADLGDMQGQPDDQYQRRQGLHQQRGLLLRSAFAAFAGGVLGEHLAHRRRQLGAIAEAAALLQQHAGQQAGRQYRHGYRRDLAEELDEMPAGLVADQQVLRLSHQGADAAQRGADRRVHEQAAEEGAEFLEMGPVQLGDLAVGGGIVVLAGALPRSDPVIHGEECHRHADHHGGHGEGVEEGREEGGQQAEQER

SEQ ID NO: 30113 - protein, 279 aa, Pseudomonas aeruginosa
QRSCSAEDYRRDRVQRIPCGAGRQDRPRPDQPSGQDQCHEPGLLARDHRDLPLGRRYRRSAGGRAVRGGQAFFLGDRPDAAGPGRQPTGQGRRPQRRRPASQDSRAAGLVQRGRQLPQAGARGDPGLLPGRRHRPGLGLRHALLDRRRAVLDQGDRHRHGRRRRHPAAPAADHRRWHDARAGLHRAHGRRRRGTEHRPGQSYLRGPGRIDGWGLRTGAADRREVADRHPWYQGNDPLYARPPGRRRPRVRRYLERRHAPVRRPAGGDGRAYGQAEAGIR

SEQ ID NO: 30114 - protein, 312 aa, Pseudomonas aeruginosa
AVHCRAAERQPAAARRRMPATDPRHPQPDRAGRRRAAGPGSPAAGDRHSHRRQRGARRPAGSPGQRPVRAAPLPGERRGQSPGDPRAALAGDQRSALCRRAAGAAGKLLLQRPPGYPAAAEHCHRPPAFRSRTGRGKPADAPHVPDRPARPDPRTEPLSQPQADGPRAGAPRQPARRGGPFAAVLDRRRGDRVDRRWPTVAAQVAQATVLAHRPRAQAIADRPGLRGAAPSAQGTALPGGAVRRPGPAFARGPRTAWAGAAAVHRPPAGRGIAAPVRPRPVGDAFAVHGDPRGTRRGQGHARPDRARRGPAG

SEQ ID NO: 30115 - protein, 501 aa, Pseudomonas aeruginosa
PDQPACATGQAEQDPRHGRPELGRHRPADPATHRGRLGCQRRRRFAAGVAAPGRCGALRGKHGRQPRTRRAPHHPADSGGARAGSRCVRRAPVGRGAHRGDRGGQGRPGPGQACDHRVPGIQWRQAQPGQRPGQPAGGPGRSLVPRSGARRAAGRRLRRLHPAAHDRDRADAFGADAGNPRRRPDQSRILSRGRCRAASAGPAGRPRPGQRQRQGARTAGGRLMAGEFRWQAGRPATAQVGGWVLAHCQQRFLQDDNGLLFPREWLKRQELPLLAEHGVGHWQGEPVYVLELDEPIELPGMAWAPLRQFMLHGDFDQFCMLGYASQIGIWARHNRFCGNCGTRMQTQDHERVMQCPQCGLHQYPRLSPSMIVLVTRGDEVLLARSPRFVPGVYSTLAGFVEAGESVEQCVVREVREEVGVEVANLEYIGSQNWPFPHSLMLGFHAEYVSGEIVPQEDEIEDAQWFSLDALPPLPAQRSIARHLIDLYLARRSGAAEPVLPG

SEQ ID NO: 30116 - protein, 551 aa, Pseudomonas aeruginosa
PRGQRQDHQDEHRANELRPAADGGARAEIGADHQRRTHAQAEQPDHLAGGDEHRQRHYVADEVHAPRHTAGADQVQRVHEQRADGPERSGARSRHAVVKAQGEALRPLALASERRIGVQRRLRRAAEEHVEAAGEYHHREHPVQPLGGQQVSRPGAYGGADRGGEQTVAPLPGMEQLAPVEGVAGGRRTEGRAQLVGTQRQVRRDPGGEQRRDGQQAAAAGDGVDEAGEKGHHGQDDQGAGVYREFEGHEKPDLLPIGKRPRWPSGGGVRIMPAISRRRNRLHAVRRSGLGIRVTGLAGRPGRGAHPLRTHLVPRLAARHLRLGLRRRGGAAAGARLGPAQLFAAQARAADGHPELPGRRAAALPGADPGGRQRAQRGAGRRTLATGRADFPLEGAGRVDRSGAGLSPRRAQRPLPGPRAAVPGPPPGLVAESAGGRSLALAAGRRARPVPVRAAGGAGDFPADGGQGGVRGELRRRRAACRADEPGGRGGAQGLALGHAKSRGGGDRLGGFAKAFDEFRRRAVGQRQPIGNSRPPPLQGTKGDPRRAQRL

SEQ ID NO: 30117 - protein, 664 aa, Pseudomonas aeruginosa
NEKREPWLPLRAFAVPSGKEAAVDVQRHAGGVAGRFASQVEHGACHFARLGHALERDALQGEVADRVVLHQRRSELGVGQPWQEGVAADAELRAFLGEDLGHADHGGLGHRVDALELAGRYAIDRGHVDDAAAAVFLHQLAALDGHEVVAADVDVDGLLEGAEVGFQYVAELRVGGGVVDQDVEAAELLADLCEDVLDLLHLADVAGDRGGLAALRGDRVGDRLAAIDLAARDDHVGALLGQQLGYRLADAAAGAGNEGDLAVEVEQVGLGHGLSPCSGRLQAGALDGLQAHLLQQLVHLHELGETLVLGLPVVVAVVDLLDDAGKTEQAIGVVEVQVVDRWDPGPLGVVVGELSAGQHARQVAGLAAGQLHRSRVAGFHPVGEGIAEVHQRIAEGGQFPVQHADDLHRVFRVEDHVVEAVVVVHDARLVVIGRLLVLEPGLDRFPERRVGGQGLLVAVGPAGDLALHVAVRAAQVGQSAGGVVDVVQFDELVDEALAQAAGLLFVEIQLRRQFGAQDDALDPFHDVELGADHRLVGAVEVGFRAVGEACVQLVQDAVFAAHVVGRLGLVAEWRATQDELLARILDQVGQVGRATGELADLRGAFEAGDMGFQVRVDDGGVEFFAGADASGLVGQRHGVPFSWCHGGAAGAGARIRLRNDGDRR

SEQ ID NO: 30118 - protein, 204 aa, Pseudomonas aeruginosa
SAFRRLSTRTDMGRSSRKDEILQAALACFSEHGVDATTIEMIRDRSGASIGSLYHHFGNKERIHGELYLAGIGQYAALLEAGFARARSAEETVRLLVTSYIDWVVANPDWARFILHSRGRVEAGELGERLRADNQAHFARIHAALAGYRAEGLFREMPDDCFASVVIGPAHDLARQWLAGRTRVALADCRELLAQVAWDSVRAA

SEQ ID NO: 30119 - protein, 245 aa, Pseudomonas aeruginosa
ASPASTSSSGLSGGALGNSCRRSSARVLCRDRARAGFTRCRGRRSNTRGSPTVENTRFLWPMPPSVPSRSMASRTLSRLCAGSPMPMNTTFFTARRRRARTTWATISRLPTWRSRPLRPVMQNTQPTAQPTWVETHSPPRGSSTLSTICRSASSTSRRDEPSLAGCSLCRRAMPSSSAATWGRPWRTPSGRKSSARWRAVQASRARPCSQARTILPQCRGLAPRSARRWWRSWLRMGRASYHCPS

SEQ ID NO: 30120 - protein, 122 aa, Pseudomonas aeruginosa
GGMAGADVLSLRSAPPQQRNRSMKFVHQREHLNEDDIVVIECSQQCNIRLMNDANFRSFKNGGRHSYHGGAFDRFPAKIKVPSTGFWNITIDTVTRRPISVTRKPNFKWTIKFVRRSGSQFT

SEQ ID NO: 30121 - protein, 772 aa, Pseudomonas aeruginosa
NRPSPSEEWFMLPRPLVGLAFVLSSFIQSVSAAEISYSRDVQPIFTAKCVACHACYDSPCQLNLSSAEGAQRGANQLPVYDGTRTKAQETTRLYLDAHGADAWRRKDFWSVLESQDGQAALMARMLELGHSQPLQPNAKIPEGLDISINRANQCPTPASIDAFIRKNPGSGMPFAVAGLSDDEYATLQKWLAAGAPVDQQPLRPTAAEARQVASWERFLNQPGAKQSLVSRWLYEHLFLAHLYFPEQGAPGHFFQLVRSRTPSGQPIDPIPTRRPNDDPGNSFYYRLWPIQGVIVHKTHITYPLTAKKLERVQELFFGTQWNTDKVPGYGVQSRANPFATFAAIPPRARYQFMLDNAEYFTRTFIRGPVCRGQIATDVIRDNFWVVFQDPEQDLFVTDANFRAQSEPLLALPGQIDELKNLLGLWSAYRDKRNEYEDLRQDVYADAPPPTWNTLWHGNDNALLSIFRQFDSASVRKGLLGEVPQTLWLMDYPLFERTYYGLVVNFDVFGNVSHQAQTRLYFDLIRNGAEQNFLRLMPVDARQPLLDDWYQNSGKLKMWMDYQAFDDDTPSALGLPEKQPKKAFAEELLRRYGDLNARPDPINRCLDGNCYRPGIDRELQDAEQAFSRLVSRPAAGLKVIERFPEATMLRIRTSSGKREVYTVLRNRAHSNVAFMLGESLRYQPGLDTLTIYPGVLSSYPNFMFDLPATDAEAFVGALEAAKSGEDFDKVVERWGVRRSNPQFWSYFHDLEAYIRETEPVEAGALDMNRYENL

SEQ ID NO: 30122 - protein, 402 aa, Pseudomonas aeruginosa
GRRGDRKVAFFVAGVSARQRPRSSYRPEQCQRHQQRRPDQQVHRVPAKAGDQGAGAERHQRRHQAVALLHQSLRGAALAFGVALAEQGGAGDEHQVPAAAQGQRTEQEMRDRLPVQGDAGTCGEQERAEQGDATVADAVDQRSGEERRKEHSQHVPLDDPTRLFQRQAAEAHGQRRGVHDQDHQPVSGRGAGDGRADHRPPQQAAYVAPGESCRAWRLAFAEQSHQQQAGEGQHGDQQIGADEGLGQRVARPQRQARRQQRGEYSAGEHVGAGAAFPPGIHRLQRGEPVVHGRGLVDPDAQRAETEPEEIASPDTGGADQAAEHAAAGAEHQPGTSAVALHEVRQRLHRQQVAQHQQGQGQGCQAVQRRQLDADQGGQGYADQRAGPVQGLAAEQQEQGRVA

SEQ ID NO: 30123 - protein, 139 aa, Pseudomonas aeruginosa
RRVGWRRGDGLAHPADALAGPAVRRRSSGTGRPGGPSRSRGRRCTRRCRSARRRCRRAGRGRSTRSWGAVPAWEGPRWERQVSMPKRSAYSWGLTERCLWNVRRRFSGWPKPHSRDTVAIDAWASCSRARAASRRTRST

SEQ ID NO: 30124 - protein, 258 aa, Pseudomonas aeruginosa
GRRPGRRPGCRRASTRVAPGGWRRGRTVVRRMRRAALPGAAPVRCRTTPGRRIPRRARRCRHRVRRAGSRAVERSGSGGGSLSARCVRRCWGSRSWNSSKRKKGAVAGPVRHFRAGGIHPWMMESVQARNGGPAASRDSSRGRTTCRQILPVSRATRRAASGSSANGSRAACSRSSRVLPASLRARPSARVERHSRDNSMFRPPGRPPGPAAAGPARCAGSARCCRPSAACRWRRWRRRAGAPRSPDGWPPAPRRTSR

SEQ ID NO: 30125 - protein, 292 aa, Pseudomonas aeruginosa
RCFRQGLKRHACPQEVFMPGHRITLTGEKQTLLITLYAKALDSRLDDSILHDRFAEEAVRQIDFDFSRVALGKGNERALAMRSHYFDQACRDFLGRHPEGQVLNLGCGLDSRIYRVDPPAELPWFDLDYPEVMDLRERLYPPRAGAYRALRHSVDDDGWLQGVPRERPALVLAEGLMPYLRESQVRRLVERLVDHLGSGELLFDGYGRLGIMLLRLYPPLRETGAQVHWSIDDPRELERWHPALRFIEEVTDYDPQDVAKLPQSSRLMLPIYNGFAFLRRMGRLIRYRWPRV

SEQ ID NO: 30126 - protein, 308 aa, Pseudomonas aeruginosa
LQLVPRVTGDPRQQRIAAGIQAHQDVGRGVGIDQFQDPYRQAVEDAALGVVAQVQADVARLYLEAQALAGGQRGVGDAHLQRAAGQDQGQQAVGRVVVADRALDHHPGIVVQRQRQVDSRQGFADRPAGADLAVLQQHQVIGQARHFVWRVADIEHRDVQFLVQVLEIGQDLALALQVEGCQRLVHQQQARAGEEGPGDADALLLAAGEAFRHAFQQVLDAQQGAGLFQLDAAFGGGDALETEGQVAPHRQVAEQVGILEHVAEGTPVGRDEEVAAAVLPGLAVDRHLALGGLFQAGDTAQAGALAGA

SEQ ID NO: 30127 - protein, 752 aa, Pseudomonas aeruginosa
SSSGRRSGATGWSRSRDRATACRTTSCAGCNSAASGRCRWRSATCAGMSMTEQGGEALYQVAVRALCEFSAKRGDLDLRFTPSPSALEGIAGHTLVTSRRPAHYQREVALDGRYRHLQVRGRADGYDPQANCLEEIKTHRGDLALQPANHRHLHWAQARVYGWLLCAERKLEEVELALVYLEVGSQKETRFVERVRADELRLFFESQCQAFLAWAEQELAHRQRRDRELAALRFPHAEFRHGQRQLAEAVYKAASAGCCLMAQAPTGIGKTIGTLFPQLKAMPGQRLDRLFFLAAKTPGRALALHALRSLEGETGGLPVRVLELVARDKACEHPDKACHGESCPLAQGFYERLPAARAAAVEARWLDQARLREVALAHRVCPYYLGQELARWCDLAVGDYNYYFDLGAMLHGLAQVNQWRVAVLVDEAHNLVERGRRMYSAELDQGDFLGVRKTAPEALRKPLERIQRAWNELAKTQADDYQAYDEPPQKLLLALQNAVAAINDLLAEQPQALEPALQEFYFAILQFGRLAELFGEHSLFDIEKRPGRNGRSLARLCLRNVVPAAFLAERFAASRSTVLFSATLGPRDYYADLLGLPAGTPWLEVDSPFSAEQLEVHIQRRVSTRYAQRQASLAPIAAILGEQFRQRPGNYLAFFSSFDYLQQALDVFRQAYPWVPCWSQTPRMDEAERRVFLERFVAGGRGHRLRRARRCLRRRHRPAWRAPDRRLHRLPRVAPGESGERADPPAHAAPVR

SEQ ID NO: 30128 - protein, 81 aa, Pseudomonas aeruginosa
SRPHDFPRSGYAMASAPDALPQALSSDDAPAQAAPSDASALLKAALAKKNQAQLYPQRKIHDKGQRPGMAPRGTRRSMGKR

SEQ ID NO: 30129 - protein, 191 aa, Pseudomonas aeruginosa
AAAPSLMLAAPGRAASMQRARLPESACCMSRHLPSSFVSLRSLAGHAPAVLCVLLLALLSASLASQTRSLRRELAELPAAAAPAPPANPSAAPRAALAGLFGGAPSPRGATAGERLQLRLLACFLARREDRSAALIAVAGRSQRFLPGAEVRPGTVLLAVHRDHVVLRDQGYEERLYFPKAEGAETTHATL

SEQ ID NO: 30130 - protein, 197 aa, Pseudomonas aeruginosa
YPFRPAPVSAVPGPVAGRPRPGAAGPSGTCRDCRRARGRAVDDQHEGCRDRRLHRAGIEHQRPDLRRRSAGEGAGHGGIPGAAQPGGGLPAVPFGARHPWLRGAAAGRPRAYRAEHGGTPGRRAEDRPRWAGQPGDAGGPGASDLGGGTDPDDPAAGPGPWPSGRRTVGQRADRQRPPLQHRAHRGDRAHPRPGRRT

SEQ ID NO: 30131 - protein, 174 aa, Pseudomonas aeruginosa
LQHLRHAPCLGRGNRRGARSQRHPGRREERRHRPGPCRQPQQPPGPARSAAGASALAAAGAVARRPLVAVGEQPGDPHAPWRRQDPCRHPRGDRRIAARRAGPGWPGKRQARPAGARRRIAECPGDPRRPGGCRPARGHRPPARRAARATAGGGGDRRAVRRDRRRPRGAMGAA

SEQ ID NO: 30132 - protein, 372 aa, Pseudomonas aeruginosa
RRPGHRPRWIDPGRPAAQRFAGTAAGRHPRRRPAVPLVPRDPGEAQPDGLPAPEHRPRCRRPGAHQPWPLPFHPVAARCRRRTGAPAVRGCRRHRPASRRPGRTGTYWLAAQLSGSSPGADGEAAPGGPGVPGRRSRRRGAGGSPGHARAAAAVTPALRRAIGRGQQRSLHARADRAASGPVVAFAPRTARWPGAVRGGAGRLPRPGAGTPGPGGTARKPAAREGAGDCAYAGKRPVTDFESSRRAPSTGLSGALRRPRSSAAPLPDLAVVAGGDGGFSSRTFFQGRAVGPQCMDDIETRVRKLVAARFGVEECDIRLDSDFRNDFGAESLEVVELVMALEAEFGVEIADDDAERIETVRQAIDYLEEAVPT

SEQ ID NO: 30133 - protein, 235 aa, Pseudomonas aeruginosa
LPLDHRPMPWSFPAKRCAPPPARAGGKVRDVPRFDYAGSSSPPRADPAFFCPPPRLRGGRRRLDFLNLPAPRRSTEQGQRAIPGACPPFVTEVVMATRRKTTPQEIDDIQDRMGSMRELDFDERRQARKARIGDERPEAEVEAEFSSRRVREAGHAGGQPDEDDGYQDNVGMDDLAPETLIDESGARSPAERGGESPADKRLRVVHGNEIGAGHGLDEAELARRDPLDGSSDEER

SEQ ID NO: 30134 - protein, 142 aa, Pseudomonas aeruginosa
ATASRSAPTPSSASMPATSTPRSARVAAPPDRTCISRCSTTAPSFPCRAPASVRTGSTSAPATTTTTVAATISTTRAPAPPIALSVLCTTPAWRSESARGPAPAGLRRERNGAEQLARRCRRARRQADRVGRHAQPRRGSRA

SEQ ID NO: 30135 - protein, 263 aa, Pseudomonas aeruginosa
SPRLRKAQRPARKVKLATSTSMIQKPSGSSAKGIPPTFMPKKPATMLIGRASTVTMVRVKRMRLFCSLSLAAISSCSSLIRSPRAVRSLITRENSSVASRNSRRSASCSHSGGRLSRRSSEPGSSASRRCRRTSTRRMAPRSARLAERRRASSWSSMRSTATLVSRTIWVSTSPWSRNRWISNCRGERKGSPCFTEERSLSTERSGCARALTSSRPRAQTHRVATSEETRPKLKTTSLTTASSAESTCSMRVERDPSRRLSKK

SEQ ID NO: 30136 - protein, 238 aa, Pseudomonas aeruginosa
PGWQRQPAGPGHRSGHYRPGAGYRRAGGAGRQQRHRQGRTRLDGGRRYRRRRPAGHHRGGRPRRQLRGSAEPAADQWRDGDGDRYRPGRQQQHPGDRRGAGHHSPGAGHRRAGGAGRQQRHRQRRAGRHRRCRHRWRRPAGHHRGGRPRRQVRGPAEPAADQWRDGDGDRYRPGRQQQHPGHRRSSRLPRRAPGQCQQRQRPQRYGGSGRDHRDHRRQRQSDRPDQRRCQRQLELHPR

SEQ ID NO: 30137 - protein, 428 aa, Pseudomonas aeruginosa
PTAGWHRGQCGGQGRRRQQQPGDLHHRRRRGAERAGGRAEQRQRTQRDCRTGQQRDPDRRQWQSDRPDHRRCQRQLVFHAVHPAAGRYRGQRGGQGCRRQQQSAGQRYRGCRRAGHAHRRSEQRYDPQRHRRAGRYRDPDRRQRQPDWPGHRRRQRQLDLHPEHAVAQRHGGQRHGYRPVRQRQFAGQRHRGPRGTGHASGQPEQRHHAQRHRRAGRHRDPGRWQRQSHRAGHRRWQRQLELHSDHAVAQRHRGQRHGHRRLRQHQCGQQCHRGLGSPGHASDQPQQRHHAQRHRRAGQQRDPDRWQRQPDRPGHRRRQRQLELHPVHAAGGWNRGQRHGHRSGGQHQRPGQHHRRWRGADHADRQPEQRQQPQRHCGTGQHGDPHRRQRQSDRRGHRRRQRQLDLHPVHADRQRHRGQRGGPGRRRQ

SEQ ID NO: 30138 - protein, 244 aa, Pseudomonas aeruginosa
QPGRQRHRGLASPGGSGGQPEQRHHAQRHRRAGRYREPDRRQRQPDWPGHRRRQWQLELHTGHAAGQRHRGQRHGQRPDRQYQRSGQHHRGLGGAGRAGGQSEQRSRHQRHRRTGRHRDPDRWQRQSDRAGHRRRQRQLELHPVHAAGGWNRGQRHRYRPGRQYRRPGQHYRGRHRAGHADRQPEQWQQPQRHCGTGQHGDPHRRQRQSDRRGHRRRQRQLDLHPVHADRQRYCGQRGGRGRRR

SEQ ID NO: 30139 - protein, 302 aa, Pseudomonas aeruginosa
QQPAGDGDRRFQRAAGAGDQPEQRRRHQRHRRGRCHRDPHRCRRQPDRAGHRRRQRQLELHAGHAAGQRHGDRRHGHRPDRQYRPAGRHHGGRGGAAGAGDRSEQRHDHQRHRGGRGQGDPHRRQRQPDRRNHRRRQRQLDLHARHAAGQRHGGQRRGPGPCGQYRPAGQHYRGRGGAEHACGQSEQRQPAQRYRRAGQHRDLDRRQRQPDRPDHRRWQRQLELHARLATTQRHRGQRDRERRRRQYQRSRYHDGGFLAAVDPAGGSEQRFGDQRHRGRRQHHHHHRWQRQPDWPGHRRRQR

SEQ ID NO: 30140 - protein, 213 aa, Pseudomonas aeruginosa
LVLHSRHPAAGWHGGQRGGAQPKQCRQCAGGDHCGWRGPGGAGDRSEQRHRDKRYRGGRRDGDPHRWRRQPDRPGHRRRQRQLDVHPGHPAGQRHRDQRRGPGPGRQYQRSGQRHRRCHRPAGAGDQSEQRSRHQRYGGSRGHGDPHRRQRQPDRPGHRRRQRQVGFHARHAVGQWHGDQCAGPGRRRQQQQSHQRHRRLAGASSPGDRSEQR

SEQ ID NO: 30141 - protein, 357 aa, Pseudomonas aeruginosa
RDRRYRRGWCHGDPHRRQRQPDRPGHRRWQRQLELHARHAAVQWHGGQCGGPGRCRQHQRPGQHHGGLGGAGRAGDRPEQRQRDRRYRGSRCDGDPHRWRRQPDRPGHRRWQRQLELHPGHAAGQRHGDQCGGPGSGRQYQRPDQHHGGRGGPGHPGGQPEQRQRDRRYRGSRRHGDPHRRRRQPDRPGHRRRQRQLELHARHAAGQRLGDQCAGPGRRRQHQRPGQHHGGLGSPGHPGARSEQRYGDQRYRRSRGHGDPHRRRRQPDTAGHRRWQRQLELHSGHTADQRHGDQCGGPGRRRQHQRSGQHHSGRGGPGHPGDRPEQWCQTQRHRRTRRPGDPHRWQWQPDRPDPRRR

SEQ ID NO: 30142 - protein, 435 aa, Pseudomonas aeruginosa
RQLDLHTGHAAGQRHGGQRRGPGPGRQYQRSGQHHGGYGGAGHAGDQCQQRQRDHRHRRGRRQSDPHRRQRQPDRRDHRRRQWQLDLHPRHAAGQRYGDQRRRRRRRGQRQRSGQHHGGLGGAVRSAAEHQRRRRAADRHRRAEQSGAYRGQRRHRQPDHGHRRRRRQLQPAVRAAADHRRTDRRGCRGRRRQRQRAGHHQRAGPGAADHQRAGSRRYLDQRRGDRGRHPGRCDGPSDHAGRPGGHGQVRRAERLRGRGQPYPHRRRHRRRQPDPDPDASRRHGPVPGGRLDRHRRHQRRHRVDPGAVHHRHHSAGDPGAVPGRQHPDYLGGARDRVDGHRRRRRGDRHRHGDRRQQRAGVAEPAHRPGHRLQLGPVAQCPGVGGRTRPGRQPEQHGEHRRRHQHRATGDHRQLRPRRQPQPAEPAFRFQRNHRA

SEQ ID NO: 30143 - protein, 186 aa, Pseudomonas aeruginosa
LQRGDPGHHPGVERRIAADPGGFVRKLLAEPAEPDHPHPVGAEHHRHPQPRLADLVQPGVHRLQWQRQRRLRDHPDPQRTVAQYRPDRCQRYFRRRRAVRRQRQFGAHQRRRRQRPDLQRGHRRSRGGRQRQRHHPDHRDRFRQHRWRRRVRHPGPGQRHRPRLQRRRRRHAQQPRAHRPRQGRLG

SEQ ID NO: 30144 - protein, 221 aa, Pseudomonas aeruginosa
RADPDRGGGGCHHRCQQHVADHRREQRHPERGGRGEYRYHATDQRHYLRRLHLRQYHPADRGQHGTGRGLMRGRRQYARKGRRHGKGAIWLLSLGLPMFASAMPLDQAVRAGLAIHPEVRSAMAEADRAGTEVEMAKGGYYPSVTMSGGPQEFDFGEIVYDLTASQMLYDWGRVTSKVDSASATQRKLSEAVLVARDDAALDIVETYLDVLASERRVEAVR

SEQ ID NO: 30145 - protein, 273 aa, Pseudomonas aeruginosa
HIQRLDGIREMTQARGGDGYADRSELDRANLELSRAQEQLSLEKGNLQDARNQYAILVGQEPADLVEPEPMSLQRYLAASDMARVIRESPLQRKALEDANVAEAEVREAKASLLPQLNLEASALRREIGGHPESDSVVSLRFRMDTFQGLSNFRRPTAAQQRLESAKWSADAMQRDIRRQLQNLFDNGDTLRWREQSLTQQVTESEQVGELYREQFEVGRRDVIDLLNVQRERFEAERQLINLRIERKRIEYRAAAQVGLLGPLLENRLNHGS

SEQ ID NO: 30146 - protein, 763 aa, Pseudomonas aeruginosa
RRDPQPRPHRRPVAPGLVAALPAAWPTARRRRTGGRHAAGARSPAVAPGGPRVAPRRHHRPGHPPAVAPDRSLPAAGPAAARRRPRPGAGGQRRRARRGAGTAERRRKPEDAAGRAGSAVQRHGGLRQVPLPAGRAGRRLRQRLARTLVLRPAQAALAFLRRGHRRGVGGQRPGGRLGTVRHAGLRPRGAQRGVRHPVDPRQRRGPGDRPRRCPADHARPPAQRARQAPRPATLDPAVLPRAEHPGRRQAGVDGRLQYPGAGVRVGARVLYLVQRGADQRPAVRGDLPADHRRDRRPCGLGAAGGLRADDPAGAADPAPARPPVAAEPARRGDEERRAAGSLRAPGDGQGDPRRRPLPAPVGNPDRRTGRYGDEDPYPGLDPELLGEHRPAALLRRRGGLRRLSDQRGRDDRRRPGGLLDPRLAGHRTAVAGGRHPRSLAAHQGGDGRPRPTDERRAGATPGQALRAQGAPAGTLPPGGRAHGPRRQPAGGRRAGPEHPRRRAGGAARRQRRRQVDPAAPAQRPARRAGGTPAAGRRQPDPDRPGRPPARYRLPAAGRGAVPWQPARQPQPGERRAGRRGTAGDPRRGRPGRLRPRPPAGAGHADPGQRQPVRRPTPGRRAGPGAATGPSDPAARRADRGLRPGQRETGHRLPAAMVGQAHPGHHHPQEKHARPGRACGGPAPGQGDHGRPAGAGGAGQPGTGTAGRRRRQPWTLTATPPPCAGNWPTRCWRLPTRSTGRCSGPCSVACCCSSAGRPGRNWTR

SEQ ID NO: 30147 - protein, 243 aa, Pseudomonas aeruginosa
SSASRCRSSTSGRCRYGRMAGRVSSRRRCSSPCCWSDCSTCTGSAPSTGRRSAGGKSRTTSRGGSPAGSGRLARRWRRSPRGRRRSPGGRRVAGGTIARRNPPAAHPRPATGAAGRAGRPSGDSRGGRSPGSPLPPSRSRCADRERRPGGGGSRWPGLPTLPAARAGRAVRPAPARRRAARRGRPPGRRRDGRGRWRWGCFGCARCARSSPCSPRSVRPVGRGSARAPCAGRLGVGQSVRRYP

SEQ ID NO: 30148 - protein, 176 aa, Pseudomonas aeruginosa
CRTARPVPPPISTSAWLLPADRRCQRSQGRPGRIGGCERFGVDGGVTARVRPDPALARYAGRHGSRVLAGDRAGPAAGAAAAAAVGGVRPRRAARARRVPARRGDWRRAAAAGAARLPAAAGARPVLPAASPTDESGETLAPGRRRGVRGRYPAAGALPDGALHHRAGQPGGECRG

SEQ ID NO: 30149 - protein, 372 aa, Pseudomonas aeruginosa
LQEPVSVDHPYLPDRSGRPGGRPAPAGRRALGGRLSRRPLLAYPALPAGHRRTGLGGPRGGQARTQPAALAGVEDHHERLLRGAGFQRLPLLRPAPGLVHHPARASDHAPYPRADRGRGLYGDLWRYRLHLRLARQPPRRGGGRGHRPGAGGAGQRLVARAPERRIRPRQRPRAAIRDPLPAFSHAHRARRRGGQQETLRRPGAPRRRWRGDGLQGPGDRAHRLVAAGPALPAGTLPAHLQSPALPGLRARLRTTDPGRRAGRPAGLPQAPAPAPRRLPAQRAAACARGAHRRRLQPRARAPAAVPERRLDQLRDQRRRSRAARGAAFGHRLRALRGQAVAAGGRRHPAVRRRRFRHFGRPADGTILRLIGG

SEQ ID NO: 30150 - protein, 441 aa, Pseudomonas aeruginosa
LSLQGRMSAQVDSLSSRSGALAAQPASRQAARRASIFMTIPAWRFFSGAPELDRSLPVTQAGRYALALSVPVSPAGCCHGGWESAGGEVVPRKAGEACVRVPWKRAWDIPERLVVGRTVEDVDMLNHHFRVCSATVYRPPGDGCQSATSQPSAWWMAAKESRSGQLRRVEHVAFEGHPAAVLAGRAVEDRAVVGEADGQAEADVGSVLRGVQLAFEVQLEHARLDAFQADGDVRVVHGLAFAAALLGADGEGHGVSVHVLLQLAWGRRRQRGGQTTGRRAGWPVLAAVGAARGLGIIRRRRSPTAHHQPTPEGMMKLPVLAVLGAALLLSACAKKEAEACASPDVKDQLMRIFLQGAITERSPEFKDSALRDVAILEKDPDSGVLSCVGTLSVPAGQQVVEGVLQYRIAPVAKSDYDYLLLDTAGANTTALAQRLNKALGQ

SEQ ID NO: 30151 - protein, 779 aa, Pseudomonas aeruginosa
RAQDQLAVRRVGGVVGDTDVRAAGPEFVEIGGAVERQAGIAGGQRVARVVEVRQVDDHPQGRGDPCVERVGRVAVVQAPDVDAEVVAALVVLQVEQRAQRGLVEGHVLGEGGVRLAPLPAARRASVGGSQFVEGAAQRLVQLEVAALFLAAPEAQVGLAVEDQPEESVVVALVPAAGQQLRADPRLQQLAGEGAYPVAGDQWRGQVGGGLVVPALEQGEGLAGAQFGVADLLQHLRQQARHHAGELVVLQLQAVFQGALAGAAEPLADAFVAVGQDPVVAEVEGIVGRHDALVRRGDEPFAGVEAAWLGAFRNVADPVVAALPAGRGGQAMEVVVGAAERYATGGDVADVALDVGIDHVLRRYAEVGGGVEELFPAFGPVDRQQAREGLVVTVEAGPGEGDHQPVALRLRQPRRFVDVADHRAVAGAADLQRDRLAVAHGDAFQARLEGPVAVRGQVAPRVLGIDALQVGVLDVQAGIGVAPGDALVMADDEQRGAGEVGAGEAQAGDLHAGQVEGRRVGQAQVRIVGQQRLAGGAAVGGDHPVVRTDALDVGTGQLPQQLAGVRRAAQGAVQAGVVAGGRRPLARIGGEHLVDPRQVQVLGQRQALQLHAQVGAQGPGIEQVQGQAVHRPPGPRPFVAHQAEFQRQRRRGQLQIGVDPVAVALQQDARGRVQVGVDALGGASEAQGAGEPVHRQGLDAEHFGERPAGIAAGELHLPQAIPGVAVAEQEIAVLQALRADMRDAGGVPGDPPLVFQAMADLDLAVLEAQRDGQQVDRAGQ

SEQ ID NO: 30152 - protein, 252 aa, Pseudomonas aeruginosa
RTESCRDRLLTGEAGMHDEREGYLEILSRITTEEEFFSLVLEICGNYGFEFFSFGARAPFPLTAPKYHFLSNYPGEWKSRYISEDYTSIDPIVRHGLLEYTPLIWNGEDFQENRFFWEEALHHGIRHGWSIPVRGKYGLISMLSLVRSSESIAATEILEKESFLLWITSMLQATFGDLLAPRIVPESNVRLTARETEMLKWTAVGKTYGEIGLILSIDQRTVKFHIVNAMRKLNSSNKAEATMKAYAIGLLN

SEQ ID NO: 30153 - protein, 179 aa, Pseudomonas aeruginosa
RYSHLINVYSNSRGDMTMLDNAIPQGFEDAVELRRKNRETVVKYMNTKGQDRLRRHELFVEDGCGGLWTTDTGSPIVIRGKDKLAEHAVWSLKCFPDWEWYNIKVFETDDPNHFWVECDGHGKILFPGYPEGYYENHFLHSFELDDGKIKRNREFMNVFQQLRALSIPVPQIKREGIPT

SEQ ID NO: 30154 - protein, 164 aa, Pseudomonas aeruginosa
SASGASPGSTPSRVPSRTSRSASRPCRSIAATWSTAARPMPNSAGPIRSGSSRAMRRRATSCATWAGTPRPGRRRMPRRSGPATRCCCSTTTCRCCARTSSAGSISVRPTGRGSASAPARSTAPMWRCWPRCSTRWPARSARKSAATSCWRSASASTRAASRGA

SEQ ID NO: 30155 - protein, 250 aa, Pseudomonas aeruginosa
TPDTTYWSFTTSPPQGGTGGRLDGRSEQFPGLGDDRREVVAEGGDLGALQIRGAQDPAVQGGYVAGGAGAIGEGAAVAVVLGRAHGGADAGMGHEAADDQVETAVVLQQVVQLGAGEGIGQAFLHDFFPGFRLQFREELAARPLRIEQAALDTQVAYMHDGRTAGAGRLHQHADLRGGGVEAWQAQGAAAVLFLGIDDQQGALPKGGWRVAASADLQKGERMRHVTTPEKAHAFHSGPYRRACEPLPHAH

SEQ ID NO: 30156 - protein, 225 aa, Pseudomonas aeruginosa
SGMDFPRWRPAPARSARMSPFCALRGAIPSCPSPVCSPCATTSAGLSAVSTPPACSSVTAPTMPGTRRATWFWAPCTFPGKFLTATWIAAWKTMNAPSWRRSSGGASRNGFRRPTCWAKPGSAGFHSASTNACWCRARLSPNLSNSASRPGCRPSRRESSTSAPVPAASASPAPMRSSRRRWCSPTCPSMRWRWPTSISSATTSASGSTPSRATVSPGFPASAST

SEQ ID NO: 30157 - protein, 159 aa, Pseudomonas aeruginosa
APVASRAWLAGAPRRRRRRPGCHCGPGRSGSGCAGGRTRGPGLRGTARSGTAARWGGAGWRAPAGYRRGSPRPSAKPAPSRPGAVAPAAGDRAVARATPGRWVGRCRRWRSIPRPACEAPPGWRSARLRYGRPGSAGRSAGRGPAARSRRPRRRHRRRR

SEQ ID NO: 30158 - protein, 134 aa, Pseudomonas aeruginosa
GLPRVAPPPGCGRLPACRSARWRFRVRPGPRRDAAGSGCCRRRGCCRRGRWDRSRRPAGPPAAARRCAAAARSRAARRARCPGRRGGAGCCWERRGPGWRAGRTGRGGRAAWRSSWADDSALIASSGEGSQARP

SEQ ID NO: 30159 - protein, 379 aa, Pseudomonas aeruginosa
RVYSDVFPCRPHAEPRMSGNTYGKLFTVTTAGESHGPALVAIVDGCPPGLELSARDLQRDLDRRKPGTSRHTTQRQEADEVEILSGVFEGKTTGTPIGLLIRNTDQKSKDYSAIKDLFRPAHADYTYHHKYGVRDYRGGGRSSARETAMRVAAGAIAKKYLAGLGIQVRGYMSQLGPIEIPFRSWDSVEQNAFFSPDPDKVPELEAYMDQLRRDQDSVGAKITVVAEGVPPGLGEPIFDRLDAELAHALMSINAVKGVEIGAGFASIAQRGTEHRDELTPQGFLSNNAGGILGGISSGQPIVAHLALKPTSSITTPGRSIDTAGEPVDMITKGRHDPCVGIRATPIAEAMMAIVLLDQLLRQRGQNADVRVDTPVLPQL

SEQ ID NO: 30160 - protein, 238 aa, Pseudomonas aeruginosa
LEQPGPCLDLRHRQPGSLAGSRYHQYPFARGAGMNDNREQLTQQIIDAGRFLYGRGWSPATSSNYSARLDEQRALLTVSGKHKGQLGFDDVLATDLAGNSLEPGKKPSAETLLHTQLYAWNPAIGAVLHTHSVNATVLSRLVRGDRLVLQDYELQKAFAGVTTHEGQVEVPIFDNDQDIARLASRVQPWLEAHPHCPGYLIRGHGLYTWGARMSDALRQVEAFEFLFECELKVLSLSR

SEQ ID NO: 30161 - protein, 183 aa, Pseudomonas aeruginosa
TATTRRRPNCAPSSSTSTAMAKTRCASSSPGAACSSCISRSMSTPCSASATTLSRCRPAPATGSTWASTRISSPCACSTTRRAGSPSSPATTSPAASPCWKTERGTVPSVTIRAPGPAGGGFIRSPHDHQSHPHRHRRHHQRGQLRFRRAVSLCRPAPAGLRPRTRRRDRGSRTVGGGACRER

SEQ ID NO: 30162 - protein, 292 aa, Pseudomonas aeruginosa
VHRMLTKRLRQNGVVVSCLLGSVLFIALAFLGWQRFAPAATVSGWTYRVVLEDIPHVSALARDPDGLLYVSQELQDGKGLVFRIAADGSRDTVLDGLSKPDGMASFRDGIAISQEQGASPVFWWHAQQARPLFDGIQVEGVASDGRYLYAAEDRDLDGRILRYDPETGGLTVLREGLQRSEGVAACPDGSVFYTEKKRGHVMRLHEGAEDEVVLNGLNAPSFLLCDSEGLWITEDSTHNARALLLPPDGPLQVIARRLRSAQSILPIGPGRYLLAEQGRDRILEIERQKSEL

SEQ ID NO: 30163 - protein, 84 aa, Pseudomonas aeruginosa
GRGAPRVHPAGGEYPADPQRGGGPAGKLPPALFLGPWGPPGNITPYFQKRVKECLLFHQFFSNGTHTHQGMFATMACFPNLPGF

SEQ ID NO: 30164 - protein, 454 aa, Pseudomonas aeruginosa
APPPAPRPAGPAPAGRGAPGEGSPGWSPAPGETAGRCTRRAAGAACRDAPGSSRKSPSAAPPATGSTRWRQFPCSSPPGLAGGRRAASSPWAARSSRRSWRLQHGTQQAQRVDGEQQGIVGVLHEDAQVEHQQQAGHQALDRHGEDEHVQRRGEAADQRQAELGEEHGDQQRRGEQRAEHQHLRELRVEECHPLAAELREETAHRPTGIAPEQRADQREEGAAGEEQGDQRLRQQQPGGAGLAAQAGVEGRGECRATLVVDDEAGRFHGPEGNGGDEADEQAEQHFLADQQGDVQRAEGRRQAAGDDRVGEQRQRTGHAVAHQAAAQGLLSQHRQDHEATDDPRQQQAVGQQQLLQVLDAHRTSGTFSRVISAKRYSSPPSQPLVANSTTTTATSLATKPRVCSWIWVSAWTSDTRVPIRAATSTGGSDRTSTSHRVWLVKWRMSALLMVSLRS

SEQ ID NO: 30165 - protein, 338 aa, Pseudomonas aeruginosa
TGPARAGPGRGSGRARRAIGSCFVVSEQAGYAHPEPILEPDQFADTEAALVGEDAHFAVQGTVEIEQRAWLQGGEGMQVQGAAADLEADRDRQLVEFVQVLAVGEGGGVVHVEQFQLRGVELAARPGASFENPQQRCVGAMTGRQQQQVAGLQGAQLAGVQRQAGPLQRQAQRYGQALRRGARRQACQQRRGIAVEPERQALVVAFQAQTQAHRSAWLRRAQAVPDQAGKDVAFALQQGQLQGRRQAGEGCLLQVRREPVGERRSLAEKAQGQAVPRQAQFEIDVGGGLGDVQARLQSVAGIVATATRETSLEIQFGAAGERQVEVRTVHSACHSSCR

SEQ ID NO: 30166 - protein, 365 aa, Pseudomonas aeruginosa
RRCRERWPLSCCWLKVSCTGCSGCSRCRRSSNSPRACWRNARLPGLALISTCNWPWPCRTCTSTAPSWGSRTCRRAAWLSAALATWMRPCTASSRRARSASGSGRLPLDASRRATRRSPGVCMAGSGTGAWSSGGSADGSVSPGCRRSSPRPSPPAVGAGGESWTLACAVDATSAAVFAGKPGPGCGRSCVRPAICGWEDTGTSGGSSTGGAETLAGSRACVDAATRAETAGACRATDPDGDTVGVGVGVGVGVGVGVGVGVASAATGTGACRVVGGRSAAGAAGWSARGVEVGASAVAAGSSASVVSSPLSNGGLGAGGRCAGRACSKAICCARSGGRGAGVSDDTSGAVSTAFSLSMARSRGG

SEQ ID NO: 30167 - protein, 440 aa, Pseudomonas aeruginosa
ILPVRLPRCVRAAPGARRRRGAPVRRTSPVAAGVPAVLAGTAAGARAPLRGAARSRRSPVPGRLPFPAAVLPAAARLPGAGGRAWPPGRRETAVALRPVASRGSPVAPPGARCVPAPRREPVAIGGPGRARPGPGAGVGRATAAPGSCAEAPQLRAGLCVIAGFVGTLAQPLADRRDLLDGLVGFAVLAFLVFADLQQQLDFLVLRQPFAQASGRMALIVVDDLVHDPAHRVQHVDGRIVVGGGQLARQHDVPVENRAGLVGHRLAHVVAFHQHGVERGDRAPLGLPGTLHQAWQRGEHRWRIAAAGGRFTGRQADFALGPGEAGQRVHQQQDAASLVAEILGDAGGDETGLGALHRRSVGSGDHQHRAAQPLFAEVAFDELADFATAFADQGEYRHIHLGIAHQAGQQGALAAAGGSEDAHALAFAAGQQAVDGAHTQR

SEQ ID NO: 30168 - protein, 319 aa, Pseudomonas aeruginosa
RQALVGIAQLAEFADAHAGHHGLEQGSGDLGDPPADLDRPAAFDGVAHPDDERRERRGHGGSVRLESARTIEKASRDEFQCQPGVFRNRLPPRLKKTGRYWHRRHRAGSYTAPPLQTRSHSHDGHPPEFLRRAPRAAGSGQRPRAAGRRQLPGRARPLRLRFAVAGRCRGRADLRLFRARREIPGQAPPERRPCAPERSPGHAAGVLEAHSGPGKPAEARGADRPPGQRSTEQPGAAQRLPGGLLQRDQPALPGAVAGARRPGRAAGGAGDAGAGRPGVAADGRRAGPGDRTRPAHRAAGRRGFRRRCRRYPGAARYLP

SEQ ID NO: 30169 - protein, 262 aa, Pseudomonas aeruginosa
MPARWHSTWRSSAKRSSSMDWVELAVAQFCQDLRVSVPAPLARVVQLDFEDSGTLQLERHGEQLSLWLACDLAWHQAYRGTLRALRPVPCARGREPAAALRLERRIAPAAVHHPGSPAGRHPDVAPGLAGAALGAQRSARRMSRVGAWHIGIERLDLAHAEPFAPPLPERHLLAPDGRPVETHVASLYPAQQAQQRLFDYARPQLEFHGLLRPGDFRQALRDLRLALTLPRQPALQAAACLLGERDEDQRLLQMAPNLLHKV

SEQ ID NO: 30170 - protein, 358 aa, Pseudomonas aeruginosa
IDDVETDATAPVADAGLVAPAMRPAATRPGVAGGLAERCAGAPRRAPRLAPGVAPARPRRARRAPVPAVAGGWRGGARSVALPEPCRTARRASRRGACRARPGAGAGGAGMNDLSGLLGRVGERKDILLVVLLLAVVFMMVLPLPPLLLDILIAVNITISVVLLMMSVYIGSPLQFSVFPAVLLITTLFRLALSVSTTRMILLQADAGQIVNTFGSFVVGGNLVVGIIIFLIITIVQFLVITKGAERVAEVSARFSLDAMPGKQMSIDGDMRAGVIDVNEARARRAVIEKESQMFGSMDGAMKFVKGDAIAGLIIIVVNILGGIAIGVTQKGLSTADALQLYAVLTVGDGWSRRCRRC

SEQ ID NO: 30171 - protein, 456 aa, Pseudomonas aeruginosa
SPSPPGSRPRVSSDESADLGSDIGEQVVAQPKALLIGGLLLVLFGLIPGVPTLTFLALALLVGGGGYFMLWRQRAHASAGSRDLPALLAQGAGAPSAKARGKAGGGKPKAGRLAEQEEFALTVPLLIDVDASLQERLEAMSLNEELVRVRRALYLDFGVPFPGIHLRFNEAMGDGEYLVQLQEVPVARGCLRPGWLLVRERAAQLELLAVPHEPAELQVPGEEASWVEQAHQDRLERSGCACLGLEQVLTWHLSHVLREYAEDFIGIQETRYLLEQMEQGYGELVKEAQRIVPLQRMTEILQRLVGEDISIRNMRAILEAMVEWGQKEKDVVQLTEYIRSSLKRYICYKYSSGNNILPAYLLDQAVEEQIRGGIRQTSAGSYLALDPAITQAFLERVRQTVGDLAQMQNRPVLIVSMDIRRYVRKLVESDYAGLPVLSYQELTQQINIQPLGRIVL

SEQ ID NO: 30172 - protein, 323 aa, Pseudomonas aeruginosa
AACWKHSRKSWSGSSPCSRPRVKPCTTCPADRQRSEETSHDRYAIFPGGYPGRDPLRADRSRRRRAFRRHAASGCGAGAGAGHAGRPGRAERSAPGARPGAHGSGRQRAGQQRRASADSLPHRAEGARAGRAPARQREPGDHPRAEGAGGRDAQRCHADDRHGGDRRRRRIGLGGGRQPRRVEERQGHQSREDPAEEHRWAQRTDRREDAGAGQDLRRGSQDRRQGLGGGPGAGQCGLACGGPCLREPQRRPAGGQHGDPVLRPDGQRLGPGAPGRIAGERPGRRGQRHHRAEPEAEGRGPDELRCRLHEGRPAAHPAVHPEP

SEQ ID NO: 30173 - protein, 227 aa, Pseudomonas aeruginosa
GFEWPHENRIDFAGAAVPRRRSRDGGAFRGAFGDPRGRSRRRPFQRGRAGALAGAQRGWRSAQRAGLAAPRRRRRHAAGGAHGPAQVRCWMLLPLALLLGGCVSQPAPMSPKVTVGGSVGGVSLQARQAQLRLRLYAVVQGRMQTIAERRYRVSGLPLRYAFDLEVDRLEGEALYLRTELSWVGVAAVQASAWQRVAAGVDERVRLVRRDCFPNCTAARPEERSGND

SEQ ID NO: 30174 - protein, 293 aa, Pseudomonas aeruginosa
VGHSRYDGKCWGSYNMQGAKSLGRKQITSCHWNIPTFEYRVNKEEGVYVLLEGELTVQDIDSTFCLAPGELLFVRRGSYVVSTKGKDSRILWIPLSAQFLQGFVQRFGALLSEVERCDEPVPGIIAFAATPLLAGCVKGLKELLVHEHPPMLACLKIEELLMLFAFSPQGPLLMSVLRQLSNRHVERLQLFMEKHYLNEWKLSDFSREFGMGLTTFKELFGSVYGVSPRAWISERRILYAHQLLLNSDMSIVDIAMEAGFSSQSYFTQSYRRRFGCTPSRSRQGKDECRAKNN

SEQ ID NO: 30175 - protein, 700 aa, Pseudomonas aeruginosa
VRNHQCAATGVAAADAAAPAAGATVPLRVVAAAPGARPGAGARRGAADSPLRGAGRRRLVRRTGRPGQPRRAAVDDRLGPAAGLWLVGKPARPGDPRLAPVAGGAGDPVPATASQVRILVPRGRAGAGAGPRGTGQGRQVPGAHPGTGGRTGRQAGDGFGTGEERLAELAAGHGDAARQRRAGRLRADPRGPRMPLATSLPAGRRRRRGGRRPGLAARTQPVPGTGSLLLAELSGRRKPALPRNHGSSVERIGHSPGPRALCCRSDGFVPPAHRRTERPVAAPGRRPAAGKPAGARPPGPAARPAGVAAGAVVAGRQLESALSPGHCPGRGRAPAVAGAAGPRRPRSRATRTGPGRPRWGCSRRWRRSWNRCPAGCRRRLRCGVPDAPPADRRTAGAAAWRGLARAAAGLAQPALRLCGAGRKPARRVGQLRRQLRCLGDRQRQGQRPGQRSLRPGKPAGLPAVDGLPLQPRLVLRRHRAVRIQDHRDAIAAGEAGAGRRGRAEARADRRRHLGAALRLACRPFRAAGARVRSGALSRTGRADRPGAGAAIHPAQRKDRRPQRGDLPAALCGRRGPQDRVPRRRDRGAGHRQHPLAGAQRCQRGCGGRRAGQAAPGTAIEPCGGPGGTVAECGGGARPQGPVAHVSPPDRSPRPALGADRGRLVDHRHQCREPRPAGRRLERRDSPGQQQVDPDPHHRPG

SEQ ID NO: 30176 - protein, 267 aa, Pseudomonas aeruginosa
CKASCRRSEHGHFTDTRIGGTGAGRQRAALPRRGAVHRRVAGAPRTGRSGAADPDFQPGQPGALSGSPGLRPWQSLAGAGALVRLVRVAPGAGRRAGPQAGRAGRQQRSCPGRLRRRHARPGADMSRIDTPPGFAVYPSASPKAANLPAVDQVLAFEQALGGEPQAAGRRLAGLENGALGERLLQRFAQPLQGLEADRLELKAMLRAELPLGRQQQTFLLQLLGAVEHAPGGEYLAQLARRELQVLIPLNGMLDNLVRNSHKLDLES

SEQ ID NO: 30177 - protein, 421 aa, Pseudomonas aeruginosa
RDAGAVAFGGRFRGQAGGQGWHRAPAGGGIGYRRGGGGAQAQGLSAGELLHAEGCVSQGRADFLAHRRARAAQLRQGPGDFPYPFRDRWRAGGAGPCGAARGARRTGQEVLAGIGLGVHQARRRRATGCLRAADQATGEQRHRRTQLRPHQRGAGAVGRGPPGPAGATLRECLLDPGGGALARTPARPVRPAAGVAAGEQPGAVLLAPATGLSGAMPLTAYQLRFCPARYIHESHLPAVLLRLLPALPDWRRQSVLNAWLLEQLELDCAFRMPAQLGGLALYPQAALERTLGWLGALLHGQALRQVLDGARVRRIRAQIGEQGQRFCLEQLDLLIGRWPPGWQRALPENPEEGYFRRCGLAFWLAACSDADCGFSRRLRLRLEAMPAPADWTFDEQRRSLARTLCLKVARQASDECFHLLN

SEQ ID NO: 30178 - protein, 153 aa, Pseudomonas aeruginosa
PAPPASRCRCLGRRRRRSCPGGTARRPSRCSACRRWRSPSPGRRRRGPGRCAGCHGAGGRRSTARRRRRSPRSGWRGRATAGRRRSPASSAGRPSRCSAWRRCRCPSAGRPAPGVARGVPPGTPARGRRPNCRRPAAATAGSGPGRSRAGSAG

SEQ ID NO: 30179 - protein, 233 aa, Pseudomonas aeruginosa
AMSDILILTHAEFCPPGHLGAVLAERGLDFRVIRADLGELAGLDAERPRAVAIMGGPMSVNDDLPWLRDELALLRRFIERRIPLIGHCLGGQLLARALGATVRHQPYTEMGWQPMQRESRDSPWLAGLPERFSIFQWHGDAFDLPQGAERLLSSPWCENQGFSWGGHVLGLQGHPEMTEELVRRWIAGWPHLLDPSQPSQQSAEDMLAGLPARIAGLNRVAEGFYRHWLSLID

SEQ ID NO: 30180 - protein, 580 aa, Pseudomonas aeruginosa
RRIAERGGIDAGTFQQRLLRTRLPRPRDGRGTGRRRRSVRPRRAGLHAHDGRTATGGRDLPKDRRRLPRPAGVQPGFAARRARPAGRLPGRQPGAGQRDRYRGGRRQVDLSLRAGHDPLLPRRRPATAQRADLAMSQAEGTGARPGAPAGAGGEGDPGFRRLRHAGRTGGQPGGNRAVPRAPEGSPGGLYRATDAVPVDLSDLRRERRRAAPYRPAAVRPVGAGSGSPGAWRADPGGVARRLAGGQFVPGRRHQGHLGGGGISMLSRTASDLYWMSRYLERAENLARMLDVSYSLSLLPQDRNGGGLDELAMPLLITGTLDAYLERHGELAAERLLSFFALDPDNPASIYSCLAAARASAHAVRGRITLDMWENINATWLEMRGIAAEGILRYGISRFCEWVKDRSHLFRGATFATSMRNDAFRFIRLGTFIERADNTLRLLDARYQTQGEAALAGADEGTARGYYQWSALLRALSAFEGYTELYRASPNARNIAELLLLREDVPRSLLSCIEELSEILSGLPGVNGRPAQRLAAELEARVRYTGIDEVLEQGLHTWITDYILLVRQLANAIHSSYLEAA

SEQ ID NO: 30181 - protein, 313 aa, Pseudomonas aeruginosa
PRGSRARRVVRRDGARAVRRRCRLRLGPSRTRLSDRVRFAHRVQHRFAMPDPRHPGAYPGGPAQFRPDGPGQRADLRLHGCAGLGGGAPRAPGVAGAGAGLQLPECRQHGPAGVPVCVRRGGDDPGGGVLPDHVDRQLQPRRVLDERRALLALAAGQSDPAQRAAGLVVDGARPATATLDGEYRRPDGRADHSADADHPRRVPGQHPPAATGQWLLLWRPASSAGGAGGLVGGAGVAIAAAGAGGAGGAVVDAGGGVQLSLRLARQSFAGSGRQPGAVFDLAVVRLHSAAADLVAACAALTARRCAACRQQVP

SEQ ID NO: 30182 - protein, 220 aa, Pseudomonas aeruginosa
AEARSAGREQDKRDRHDRRIHLRRRAYSPRQGQEGWRAAQRQAGEPDGRAVARGPAAQRPGYRPGRRYRARLRDAGGRPGRRYRQDRGAGGRLGRTGCRRADQPFLRLRPGGGEPGGDEGTLRLRGPGPGRWRRVHVTRADGLRRRRLGTGSGNQPAHQLRPARDRRRPDRHPGRLQSRRCRCLRPALPAEGRQGPRRRAVRQVAGAGRRPEWHRPARPR

SEQ ID NO: 30183 - protein, 365 aa, Pseudomonas aeruginosa
RWTSPKRSAPRWRRRSRCAPGPRAGRAHIDGESMMRRQASVLLLVSMVSATVLPVFARAPGEREPSCAATSIVLPAGARYPNGIAHAADGTLYVGLVTSGRILRKPPGGEWESFFAGSPAIFAATALRLDEPRGLLWGNSPDFLPAGRRRPHGVFALDLATGAVRRYLTLPGDGMGNDLAVAPDGTVYLSETRDGSLMRLRPGEPAFQVLLRDSRLAGPGGLGAAGIVRVDDDTLLVGNFGSGAIHVVEGVATRPRLREMELPRTLENPDGMALAPDGSLIVLENAIRSGAGKVLRIAEPLAPGRRGIEVIREGLESPVNLTVTGQGCAYVSESRIRHRLLPGREGEVPARFLIHRLPLDAAGGR

SEQ ID NO: 30184 - protein, 256 aa, Pseudomonas aeruginosa
LNQTKTTITPLLQRVFMSLRICILETDILRPELIERYEGYGRMFQQLFAKQPIAAEFVIYNVVEGRYPADDERFDAYLVTGSKADSFGPDPWIQTLKTFLLDRYERGDKLLGVCFGHQLLALLLGGKAERASQGWGMGIHQYQLNERADWMSPALPDLTLLISHQDQVTRLPENARVIASSDFCPYAAYAIGDQVLCFQGHPEFVHDYSRELLELRQQHLGEELYRKGVDSLAGDHQGTVVAEWMMRFVARQPTGA

SEQ ID NO: 30185 - protein, 249 aa, Pseudomonas aeruginosa
RLPLVVTMDTPPCWLMPRKRCGLETDCRALIATVRLPSVPFLKPTAEDRPEAISRWVCDSVVRAPIADQLIRSCRYCGEIGSSASVAVGKPFSARSRSSWRPMCRPSWILNESSRYGSLIRPFQPTVVRGFSKYTRITRNSVSATSAASALRRSAYSWAALMSWMEQGPITTNRRWSLPSRMSRTTWRPWATVCRALSVRGISRLSCSGVIRVSLEATLRSSICKSAIVVLNQVTGAGRREAPCERAQA

SEQ ID NO: 30186 - protein, 204 aa, Pseudomonas aeruginosa
SSQTGRRTLTCRAGPRQWAGRGSPVFSPLCARFLRCSGPRLPAELQVRPPRTILCRCCGGARLARIRWPRRAPALSQEPKPTDDGRAPFLPFYRGQQRAVPGTHRSGRRPAVACPGRGFAVGIHQRRLRVVPLGPAPSPRDGPAHRAPVLGGRRPQWRPGGTLRRLSPAGPVHGPRRPLPWRTERSAAPGSLAGCGAGGVDRFT

SEQ ID NO: 30187 - protein, 319 aa, Pseudomonas aeruginosa
GVALMDSKQQRIGVIGTGAIGGFYGLMLAHAGHDVHFLLRSEFEAVNRAGLSLNSAVHGFRRLAPVQAYHSAQDMPPCDWLLVGAKTTGNHELAPLIRAAAAPGAKVLLLQNGLGVEERLRPLLPESLHLLGGLCFICVHRGEPGVIEHQAYGGVNLGYHSGPADERRRREIVEEGAALFRESGLESTAMPDLEQARWQKLVWNIPYNGLSVLLKSSTAPLMANADSRSLIEAIMEEVIGAAGACGFILPEGYADQLLAATERMPDYRPSMYHDFAHGRPLELAAIYAAPLARAAAAGYRMPRVEALYQALRFLEAQPR

SEQ ID NO: 30188 - protein, 179 aa, Pseudomonas aeruginosa
SANEARRAGCRGGRMIRSILYATDLGLYAPYVLQHALSLTRAYNAELYVVHVVEPLGLFAESVLQTYLDTERLQDLRAQGLDNVMESIEKRVLEGFRDELGELPQDAALVKSVRVVQGDPPQMILDEAEKLAVDLIVAGSHSHGTQLDTPLGRTAARLVQLAEVPVYLVPMLQHRSRDL

SEQ ID NO: 30189 - protein, 256 aa, Pseudomonas aeruginosa
PGRRAGSGNLDRVRGKNRYRRLEGDHPGHSGLRRADEAAPAHPRRTWSEAGRHPGGDRHPEAAGGGGGIRRLAARALPGGDPLRHLLRVLPAADAPAGLPDPVVPQAGDRRQRPGGRLSIAPEGSQAAVGDRLQEPLLPGDRRRRLLQRHHHAFRGPRRHPVPCPGKRDPRVSPVPRGAYLRRPQARVPQGFQPFAESVAAPPMKEPAERGLFSIPGTLSRPSLPGFPAAPGPCPGFPGTRPPSASRRRCRRRPSN

SEQ ID NO: 30190 - protein, 936 aa, Pseudomonas aeruginosa
SHFFSLRKKGDLLIMEISHGDLAPYHNDNDTGIQAVDAVQDPAAGSLSRSRIVPPQVPAEYSLRPAIRNLLDRNPHSRVLMFSAPAGFGKTCALAALARERTVADQAVAWLSLAEEDDDPARFCRQLIEALGEAVPQLGDDAQTYLQNTMRVPVVAVIESLLGDLDRYARPLLLVLDDLHLVSNPDIFTGLNRLVQYAPPGLVLALGTRSQPALSLATWRAKGLLLEIGLEELRLGFEETREYLERSGLYLDEPCLKALYGQTEGWVVGVHLVSLWLRQQPQVQEMALLDGDKQAVSAYLLAAVFERLPGDLQEALLALGVASQLSGDLANALTGRQDGQALLERLESMQLFLLPLDRERQWYRFHLLFADFLRNRLRDSDPDRFKQLHFNASLWFTNHHMPTFAIEHACAAEDPEMIAALVDGCGLELINRGQLSLIYRWRKHVPDEIAERYPILVLTDVWSRASDLSLGEANRIIDELLARWGESRGDGPMGDQYLSALAVKAVVALQKDDLELCIALARRVEVQLGQNAAFLEVAVLITAALAQVVRGQGDQARRLLGLAQQRNHFLEGRYLDMQLANVEVILALEQGQVKQAQLLIERLRQRARPLFEKSRSALALPTITEALTAYYRIELDGLEERLGWALGHVDVINPIDFYAQGQICLARTQRLLGRPKEALASLAAMQALASRNQSWRFFAQAMAEEINLILQDSGPDRLKRAEQRLKSVDWNKMAAHYRNMAFNPVNWSLGVSRVRLLQGRGHFSEALHEITQLRGTLQPGWHGLQRLRLDILAALSYQRLGYQERANSLLGECLINAEREGVRSLFIEEGDGIRQLLQQLESTERQPALQTFIRGLLGIWPGQGVRKPQDALEEGLTEREREVVCLAAQGLSNEEIGQRLSLALGTVKWHLHNIYEKLKVRNRTQAIRRARELSLL

SEQ ID NO: 30191 - protein, 402 aa, Pseudomonas aeruginosa
TIATCAWWTTAPSACWRSASFRRSTRSLKTRSVSWALVATSYTCAPSSRYPKTRTISGDSAMRIRGYTCAAALMLSISGLSVAEEASVDQARDALAKKNDDADSAKALEEVFQAAEKSYTLLKKGERTLTYGFDYALVRDQRLTLVPLTKTSGGTQIYGLAGRQSQSQHTFTNSFTFDYGIWDNLTFSFRLPLVAKYDTEMDTHAYSLGDVSATLRWQPWAAVRGRPVTTLYTTIGLPTGDSPYKTNLDKDISTGNGYYSLGFGANMSYVIDPVVLYGSLGYTWNLPVDDVHQTLADNSQLEKVSPGNTINFNMGMAYALSYDVSLATSYQMAYTLKNRYHTTAGTFESSEQTSSIMNFSLGLRTSPDYIVNVNAGFGLTEDSPDVLLGLSVPLDIKGLKAQ

SEQ ID NO: 30192 - protein, 143 aa, Pseudomonas aeruginosa
TRRTTPRSGRGTAAEGRASVATTPGSMPTATCRTASMPAPRSPASAPTTSCPTASTPPNTSTPRPSRARVSFAARTAVPTTPGWTRRAACTTRRSRSRSARRASSGRPRLRRRSPSPRAGRSSSSSVRRRCPGWMAPASRAMR

SEQ ID NO: 30193 - protein, 195 aa, Pseudomonas aeruginosa
RKWRLRSRRRRRGGRPMFLRSCPSRSLHPQELPMHYVTPDLCDAYPELVQVVEPMFSNFGGRDSFGGEIVTIKCFEDNSLVKEQVDKDGKGKVLVVDGGGSLRRALLGDMLAEKAAKNGWEGIVVYGCIRDVDVIAQTDLGVQALASHPLKTDKRGIGDLNVAVTFGGVTFRPGEFVYADNNGIIVSPQALKMPE

SEQ ID NO: 30194 - protein, 326 aa, Pseudomonas aeruginosa
RARPDLWLRPQRARRRTPCRTQPDSGARPAAGGKPLAALGPRRAGSAGLAAGFRGAQRVRLRSAAGGGDSPPFARSRGRKPAGVPPWSEPESGRGAGRHGFAAGIRRRAPGDLAAPAAAEGGGRSARGPGGGERAEDSIRGRVLPRALPDRSRRHADQRHSRPARCCRGAGRGGRARQSRPAPVAYPAPPVGGVAALPGAAAGHLLATGALQAVLVRRGRRRLLERAEQPADAESRRTRVDTGAHQRPAGSRVAANHRTDEPHHVSPWYNHRLFPADELRHRPAGNQCRRHSRGGCTAWVLAGLPADRRGRHLPVVGISSAALALT

SEQ ID NO: 30195 - protein, 276 aa, Pseudomonas aeruginosa
VNMQFDIWTQSLLTAMNTLWGKLAGFIPNLLGALVVVLLGFVIAKLLDALLSKLLAKLGLDRLMGGTGLTKLLARVGIQVPVSTLVGKIVYWFVLLVFLVSAAESLGLQRVSATLDVLALYLPKVFGAALVLIVGVLLAQLVNSVVRGAADGVGLEYANGLGRIAQWLVIIISISVAVGQLEVKTDLLNYIIAIALITVGLAAALALGLGSREVAGQIIAGIYVRELYQVGQQVKVGDVEGTIEEIGTVKTILLTEEGELVSLANRLLLDQRVTSR

SEQ ID NO: 30196 - protein, 106 aa, Pseudomonas aeruginosa
CATSARWPGSAASRWPGSRLARLPVSRPPMAFGWPVRENGPHPARPILPVARCRLISALFLALPALDWLSPMHQSERKRGERPIHSAQRCRSARSMPQMSATAAGV

SEQ ID NO: 30197 - protein, 140 aa, Pseudomonas aeruginosa
VCRVSLTRMPRLQGMPALSASSVLGRMPAAITTRSAGITSPSLNCTAQTRPLPLSISSWVWVFRRKRMPRASSAPCRSLPAVRSSWRSSSQSERCTTVTSMPRCLRPLAASRPSRPPPITTAWLWVRAQSIMAWVSAMSR

SEQ ID NO: 30198 - protein, 1239 aa, Pseudomonas aeruginosa
ASTKARVVPRTFSGWSGQIAWLVAMVKPWPWSTARAPQGPPAQNPSMRPAWRWPTICAGGTTTLCTSCSVCRPMLGSPVVQPERVGTGGERSAPGSGVHHSGADAGAVPPALVTPACFRRFGKIDRLAVLAQSHEHRHLACRAAAEAELDAVDKPVQALRGIQLAAEQLVAQGGPGRLAPEIEREAVGLGEALGGGHDQRGRIGQRHETDVQGALFRCVGTAGPGLAAYRSVCHHHLKCGRAARAVPFSSAPAPSSARFSIAATASAMPGGAGGFAGQEKAPHGAGLVRRVAGSGLDDRDLGVRSRFAELGDLVEAQVAVDVGSHAVDVLRVGHVLLHGRQFAEDRGDRRQLGRCQEHIGGIAQTVREVTGRSGDHGGTGLDASLVAHAQRAARHFHARASLAVDAVVAFLGQLVGVHLGRRSQPQTGRDAALDLVQQLAGGAEVTDVGHAGADEHFIDLAALYARQQTRVVRIVRRAEHRLLDVGQVDLDHRGVLGVLVGFQQLRLGQPGFHRLGATLQGARVAVAFADHPAQQGDVGLQVLGDRLFRQLDGAAGGGTLGRGVGQLEGLLHGQVVEAFDLEDAAGEDVLLALLLDGQQALLDRVVRDRMDQVTQGDARLQLALEAHQHRLRHVQRHHAGGGGEGHQAGAGRERDADREAGVRVAAGTNGIGQQHAVQPAVDDAVARTQRHAATGHDEVGQGVVGLDVDRLRIGRGVAEGLHHQVGGEAEAGEVLQFVAGHRAGGVLGTDGGHLRFAVGARAHALAFRQTAGAADHFLRQGEALAAIGRCFRLAEQVGGAQAQLGAGLLGQATADDQRDTAAGADFVEQDRGLQLEGGDHFAAVVASDLAFIGVYVDDVAHGQVGAVELDRQGAGIFHGVVEDRCDLGAEAEAAGTLVRHERNVVAEEPQHRVGGGFARGTGADHVADVGDREALGLDRFDLLQRTDRTRLDRLDAVAGHLQHGQGVQRDVRARPGVGGRGEVVGVGFAGDLEYGERQLFRDFRLGLEPLAIGPGLQHGLGRGIALLGALGDVVEGVEHQQGVLQLFGGGVGQFGVVQQLDQGGDVVAALHGAQQLGGTLLVDKGGGGFALDDGGKETGLDVGGFVDARRYAVGDQVKEEFFFAGRRVLQQLDQACGLFGVQRLGHDTLGGTLFYVFAVGFKHSISLISGPGGHVSRNRRRSARQAQVDGNPPTYEGIGRFQTEAVFKVLRRRAGVGLARRLREAPSPAYLPETVLVTL

SEQ ID NO: 30199 - protein, 170 aa, Pseudomonas aeruginosa
LDKGLRCRFVFVVPAMSSQRIKTPCVGLCSTVYGDLVCRGCKRFHHEVVNWNLYDAEEKRAVWSRLEQLLAQVMAAKLEVFDAARLRLQLEQRQIRFVPEQSPYCWAYQLIARGSRLINQIEAYGVALLPEFRDWSLPDLRDAIDREFFLLSEAHYQRYIAPSFLQAIDR

SEQ ID NO: 30200 - protein, 207 aa, Pseudomonas aeruginosa
VTCTMLPEIDQFLACSTPAAWVEAALERQDVMLLDHKACEMKAAATAMQLIGKYSGRLDLVNKMSRLAREELRHFEQVLAILKKRGIPVVNVSASRYASALRDLVRKHEPQRLTDTLVVGAFIEARSCERFAALVPHLDAELAKFYGGLLKSESRHFQDYLKLAYQYGDEADVERTIEVVRAKEAELISSPDNEFRFHSGHPVGLVA

SEQ ID NO: 30201 - protein, 473 aa, Pseudomonas aeruginosa
AGNKKAPRGALFLLPGSVLDLEVEGQVAGGLGRQNAHQLADLVLAARRAVGAGAHHYAGDGGLGGGFGPDLVDRDQRVELRLQRAVRLDHRFAGVSLGVGGDLGGLGGHRGLVAQQFGGLLLDLGALLLALGVDHRQLLVGFRLGGAFDLVAQGFLALGLDFLLAAGGDQQLFLFFLQAVLPRHRQLGERLLDLDHALLVLRVGIDVGDPRFHHLDAELAELLLLAYRDALGIGDLLGDELAGVVVAERSLLGAGLEDRGLVRNGAARPADFLALDQVQAVVELVLELGGEFAAGSGVVVVGAHQRSGGLEGFLDRRHQCGADEIVRVAVFLGHLQERLAAGQAKARGRFDLGVDVAEEHDRESLDGGAEAVVVRIGVVIVHDQHGLHADGLLPGGGATEPLGRVADVIDDLLVAEDGPYVGHEAGFVIEEHAVEQAEAEGEHAEGGGDELDQVSLRDDHDHSLMRGGGARSC

SEQ ID NO: 30202 - protein, 393 aa, Pseudomonas aeruginosa
QDHQSRQRERRAVRCADRAHDRGDARGRGPAEHPQAGPGATRHRSHRRHARDDPDPDRQGLCLRAGQRGRVLPGRQVRWLRQVVAAAGRGPAHRCADRAGRSEGGSARFRALEGRQAWRTELVVALGRGAPGLAHRMLGDVHLLPGRFLRHPWRWQRPGVPSSRERDRPERGRDRQALRQVLAALRDDHHQRREDVQVAGQFLHHPRSAGEISPRSGALPADRQPLPQSDQLLGGEPARGQGGPGPFLQRAQGAARGGAGGSGGVCRALRRGDGRRLQYRGCLLGAVRAGAGGQSSARKRPVGGGRAGRAPEAVGWPAGGAATGAGSLPAGGRRGQGRCGRGRGADPGAPGGAGGEELGGVRPDSRSAHRHGRRAGGWQGRHYLAPGRLNPQR

SEQ ID NO: 30203 - protein, 181 aa, Pseudomonas aeruginosa
CLSGCRGAGGACAGPGGRCCRDGNRPRPCPGGCAPAAGRRPGGRAGVAGPGCRRWRGRRSGGRSGPAGRPGWFRREDRRPGRESRLPRSPCACAPHRPERPDRCRPGSPPGRERAGLAGGARSRVGLSAGEGWRRSLCRRSVVRSCRKGNHRIGWKKDAHFRMDAARGKGGDPWICRNSFI

SEQ ID NO: 30204 - protein, 820 aa, Pseudomonas aeruginosa
PHLRLKGLPICFVAKCRCRADIMKTLVELPLLPLRDVVVYPHMVIPLFVGREKSIEALEAAMTGDKQILLLAQKNPADDDPGEDGLYRMGTVATVLQLLKLPDGTVKVLVEGEQRGQVERFIEEEGHIRAAVQAIDDANVGEREAEVFTRSLLSQFEQYVQLGKKVPAEVLSSLNSIDEPSRLVDTMAAHMALKIEQKQDILEITDLSSRVEHVLALLDAEIDLLQVEKRIRGRVKKQMERSQREYYLNEQMKAIQKELGDIDEGHNEVEELKKRIDAAGLTKEAHTKATAELNKLKQMSPMSAEATVVRSYIDWLLNVPWKAESKVRHDLAKAEDILDADHYGLEEVKERILEYLAVQKRVKKLKGPVLCLVGPPGVGKTSLAESIARATNRKFVRMALGGVRDEAEIRGHRRTYIGSMPGRLIQKMTKVGVRNPLFLLDEIDKMGSDMRGDPASALLEVLDPEQNHNFNDHYLEVDYDLSDVMFLCTANSMNIPAPLLDRMEVIRLPGYTEDEKVNIASKYLIPKQVQANGLKKGELTFEEGALRDIIRYYTREAGVRSLERQIAKVCRKAVKEHAKLKRIQAVVSSETLENYLGVRKFRYGLAEQQDQIGQVTGLAWTQVGGELLTIEAAVVPGKGQLTKTGSLGDVMAESITAALTVVRSRAQSLGIAADFHEKRDIHIHVPEGATPKDGPSAGIGMCTALVSAITQIPVRADVAMTGEITLRGQVLAIGGLKEKLLAAHRGGIKTVIIPEENVRDLKEIPDNIKSDLVIKPVKWIDEVLQIALQYAPEPLPDAAPEMVAKDEKREPDSKERISTH

SEQ ID NO: 30205 - protein, 103 aa, Pseudomonas aeruginosa
HIETYSTEIRGLRVNKSELIDAIAASADIPKAVAGRALDAVIESVTGALKAGDSVVLVGFGTFAVKERAARTGRNPQTGKPIKIAAAKIPGFKAGKALKDAVN

SEQ ID NO: 30206 - protein, 698 aa, Pseudomonas aeruginosa
ASFGTRSTQVGQGWPGCGAVVQSVRIPACHAGGRGFESRPLRQLREGASSDAPFLYPHLLPTPRRPRRLVVAVFGGCMLQNIRDNSQGWIAKTIIGVIIVLLSLTGFDAIIRATDHSNVAAKVNGDDISLNEVQQAVDMQRRQLLQRLGKDFDPSMLDDKLLKEAALKGLIERTLLLQAAKDDKFAFSDQALDQLILQTPEFQVDGKFNADRFDQVIRQMNYSRMQFRQMLGQEMLIGQLRAGLAGTGFVTDNELQSFARLEKQTRDFATLAIKADASKSSVSEDEVKAFYEGHKSEFMTPEQVVVEYVELKKSSFFDQVKVKQEDLEALYQKEIANLSEQRDAAHILIEVNDKVGDEQAKAKIDEIKARLAKGEDFAALAKEFSQDIGSAATGGDLGYAGRGVYDPAFEEALYALKQGEVSAPVKTPYGYHLIKLLGVQAPEVPSLESLKPKLEDELKKQMVEQRFVEATKDLESSAYEAADLSQPAQEMGLKVQTSQPFGRSGGDGIAANRQIVQTAFSAEVLEEAANSGAIELDPDTVVVLRVKEHNKPKEQPLEQVAANIRERLAAEKAAEEAQKRGEALIAELREGRTSSAAGESWKVVEAASRGQEGVDPKLLQAVFRMQRPEAKDKPSLSGVTLANGDYVVIRLNGVSEPEEAISDDEKAMYRRFLASRSGQADFAAFRRQLQDKAEVEKY

SEQ ID NO: 30207 - protein, 83 aa, Pseudomonas aeruginosa
RRARWSVRRRSAVAARRPGPWRSSPAAAGRRRVRVDRLSGAWPARGCRPARAVREFSRWPWRHPGPCAGRGPRRAASRWYAAD

SEQ ID NO: 30208 - protein, 1045 aa, Pseudomonas aeruginosa
CTTSGLSLAISSAPRLPTNRMRNSQSDHQPRLLLLKRAQRRWLMGDRRIGLLPVLEVDARIDQGVDDIADQLHDQPEQGEDEQRAEDHRVVAVHSRFEAEQAEAVEGEDHLDQQRTGEEDPQQRSRQAGNHQQHGVAEYVPVEHAAFGQALGAGGDHVLLADLVEEAVLGQQRDGGEVADHQGGYRQGQVPEIVEHLAAEAELVEVVRGQAAQGEPVPVAAAGEQHHQQDGEEEGGNGVADDDRRAGPDVEDAAMADRLGDPQRDRHQVHDQRAPEPERDRHRQFLDDQVGDLGVAEEALPEVQVQVVLQHDHEALGGRLVEAVHALDLFHQLRVQALRAAVLRAGHGDFAAAAGDAPGGAAGSGVEAFQLGDHLLHRTAGSGLDDDEVDQQDAEQGRDDQQQAPQDIGEHAALLPFRLGVLRGFGLRLARQRLVAGLPPGHQAPVVEWRHLRPAETVPVGDPPGIDVVVRNHVVAPRQYAVEGAGMVDQALPRVGLDQAFHQAVDGRVLEADEVAAAGLVGAAGMPELSLFVAWRVGLRPGRRGHVEIPRAQAVDELRDVDATDLHVDAKFGQVALERQDDPFHVGLEQHELEAQWLAVGTYHAVVLDPVAGLGEQLVGLASLLADHPTAVVDRILEDLVEGLVGNLAAQRFEDLQLGFAGQLVGGHLRVLEIAVGALVGAEEQLLVRPFEVEQQADRLAYPAVLEHRAADIEGEALHPHRVVVVDAGLDEAPVAQCRRLVAGGPVLRRIFEVDVVLAGLEGFQGDRHVAIGVDGDGVEVIESAGDRKVLGPPVLDSLVADGASRIDLGDAVGAAAHRNFHAGLGKVAVGPPVFRQDRDLAEDQRQFAVAGVLEVEAHAKLVLGDHLVDVRIVVAVHRVALAHQRLEGEHHVFGGDRRAIAETGLGAQVEAHVAVVRCLLDLLREQAVFGERLVLRLEGQGVVDQAQRRGRDALADERVKAVEAAEVGLAEDAAFRRIRIHVVEMLEIGGILRRLIVERQCMFRGGEERAAAAEQQGCQQRGEAGTDHRDVSRFFCHHARRPRV

SEQ ID NO: 30209 - protein, 424 aa, Pseudomonas aeruginosa
YCLFSRRAGVRRREGEDAGGTHERTASLRPDRCRVAGIDQPGARLVPGPAGQPDAGRGATPVVRRADPLLRWLPGALRTACRTAAEHRADSARCAPGAAAAGRGHRLRRGRLAAQRTCRGRGPAATRPGFLPVASPSPARSRAYRSSGRPPAADRHQPMEPVGHPSLFRRGCLAPGPLHSSVAGLRLAQPAGLRAGETALRVLSSAACVGSLAIAPGSPGALGRRLAVFGRRLLSIGGTQAGRGVAPVAPEQARTARSAGAHAGGESQPARFRNLGMTDKEQVVIYTDGACKGNPGRGGWGALLLYKGAERELWGGEPDTTNNRMELMAAIQALAALKRSCPIRLITDSEYVMRGITEWLPNWKKRGWKTASKQPVKNADLWQALDEQVARHQVEWQWVRGHTGDPGNERADQLANRGVAELPR

SEQ ID NO: 30210 - protein, 153 aa, Pseudomonas aeruginosa
RSDKRCASLSLRSRAERSMLLAGGRGGKRGAPTCVAATFSYKGKPPGVTRVPASLYPEPTGGVRPPAARDQQCIKTSNFPSSSSIATSRPTPLPANACGASPTNWSRTASAFSPPPAPPRGASSLPPTTAWPAFWSPPKVPGKTSACCRMWSN

SEQ ID NO: 30211 - protein, 305 aa, Pseudomonas aeruginosa
CSIDIWLALVIVAGFSAQQKSLRSDSAVALPRTIAVTEYNAFRVELADKIAHVQINRPDKINAMNQDFWREIIEIFRWVDDTDEVRVVVLSGAGKHFSSGIDLMLLAQVGSQLGKDVGRNADALRRKILELQASFNAVDNCRKPVLAAIQGYCLGGAIDLVSACDMRYSTADAQFSIKEIDIGMAADVGTLQRLPRIIGDGMMRELAYTGRMVDGEEARSIGLVNRTYADQAALMDGVFELARQIAAKSPIAIRGTKEMIRYMRDHRVDDGLEYVATWNAAMLQSADLRVAMAAHMAKQKPEFAD

SEQ ID NO: 30212 - protein, 575 aa, Pseudomonas aeruginosa
CRCIFLRGRRTRPMVTGATSLSLVRDELFATMEQAEQGLEQFIAERQNGSLLQHAVECLQQIRGTLNLIELAGAELLAQEALQLATDIPTGVSEERDGQLAALGNALYVLRRYLENVEANRQEIPELLLPAINEVRCAAGQPALPESFFFSARLDIPRPPSTAIDHLPSEAELGEESRRMRHMYQIGLLGLIREQNLYPSLKLMGRALARLDSLHGGVARSRLCWIGAAAIESIVDGQLLPRKSRKQLFSRIDRELKQLLIGPAYEAPRHLLKELLYLVALSDGQGPRSREVRELHGLAPLPFTDHLLEEESQRLSGPGQSVMRSLSTAIREELAGVKDMLDLIERGVAQPDSLTNLHAQLGKLSKTLGMVGLNSAGTALQTQLPTVAAWAASGVADSPPALLRLADAVLYVESMVGNLERGERRIIRPTPAEPGQEADAFAVHQLAEARIVVIEEAKAGLALAKRAITAYLESNGDKLNLANVPASLQAVRGGLWFLGQERAALLVGGCADYIQQRMIETAQMPSEQMLETLADALTSLEYYLEGGAVLRPQGQPDVLDLASASVKALGLPVAA

SEQ ID NO: 30213 - protein, 225 aa, Pseudomonas aeruginosa
CPQFHAEGIACMQYDGLAWAFALLALLAALVAVRILFERTWFLGWLRGTCGLAFVAVAALLLVLAWDLRSYSLLKPEQPMATLSFQAEGPQRYRVLIQEGANERSVVLDGELWQLDARIFRWKGLAALIGLAPGYRLDALSGRFLALEQQSRGRRLGLSQSPLGVDLWRWLRAGEHDLFLFEPLAGRVTFLPMADKAVFAVNYGVAGLLAEPMNLAAEEALRDWR

SEQ ID NO: 30214 - protein, 345 aa, Pseudomonas aeruginosa
RGGCVEFIAEYAGFLARTVTVLAAIIVVLVVIVALRGRGRRGAGGHLDVQKLNDFYKDLRERVRHSVLDKASLKALRKEESKAAKQAKKHPEQKSRVYVLDFDGDIKASATEQLRHEVTAVLSMAGKDDEVVLRLESGGGMVHGYGLAASQLARIRQAGVPLTVCVDKVAASGGYMMACIGDRILSAPFAILGSIGVVAQLPNVHRLLKKHDIDFEVLTAGEYKRTLTVFGENTEKGREKFQEDLEVTHELFKNFVAHYRPQLNMDEIATGEVWLGQAALGKLLVDELKTSDEYLAEQARERDVYQVQFVERKSLQERVGLAASVVIDRVLVTWWGRLNQQKFWQ

SEQ ID NO: 30215 - protein, 361 aa, Pseudomonas aeruginosa
AGADRDEHAVFRVFTRGGRNGCIQGVVGDGSAPRRLRNAGGRARYRRPAGGRRTDPRAVFLAELQGCAVRQRQPWGDPQVPAYPRHRCRRCGRRVLGGRVRGRRRGDRHRLRPGHEHRRRFRPVHPRARGLGDQAPARPEPARGDDPRHRRPDRGALRRKAGAQRPAPRPWLGAGHRRQRRGRQYRRGTAGQARLHRGGRHRQAGAGRVPQPPGGQADSRSRHRGRWRRQAVAQGTVGRRGGHRRRRHPLQRGQVVAVRRQRRLLRPDRRRRLQGLGAAVHPARGQPARGGLGGAAAGGQGIHVGQAVAAMEARQPRRGGARDRPRRAAGGDQPDPRRQAGRPGAGQPRLRALPEPSSGNR

SEQ ID NO: 30216 - protein, 73 aa, Pseudomonas aeruginosa
PLRNGAFLERWAALVLTGECLSMSSSRYPQETGGVMSEPSKTQENRDSVVDARAAFVLILLVVATAVFWVSHQ

SEQ ID NO: 30217 - protein, 191 aa, Pseudomonas aeruginosa
RASRTSSGRSSSCAVPVRSSPEGARPMSAKMDEQALLALLRELAIDSQRVEHPAIASIEEYYAQGIELPDQGIKNLFLRNRKGTRHYLVLLDERKEADLPGIAEQIGESRLSFASVERLREYLGVELGCVTPFALVNDPRHRVEVLLDDAIRQDQLLGFHPLVNTATECIRYADLLAFLAHTGHEPRLIRV

SEQ ID NO: 30218 - protein, 447 aa, Pseudomonas aeruginosa
TVGIFARSCHERHHHYRSCPSVSGRVAGEAEHPGYRHSYLHHPAGYPVRGNLHRLLQAGRGKGRGHRHRPEGLHCLDRCGQRALPRRRGGGLRHRPHGRPTDHQGAERQGADGQRGQPDHRTHQLLPADRDQSRAGQPRRTGEPGRRGRGQHRRVAFRRRLPGLRDGRHDPQGWRREDPDRAYSRTEGRARRDRPQQQGERLLLRRFRKAEEATARSPFSLPAFQRDSVRVRRTGQSSVSATSSAGQTSRFTAFQPRLVIRAPEPNDISAATRLLPCSINPCAAPRSLSAWPSPSRVVPAMSIRFQPLPRASELSRKCVTDCPSRAMPALAASRNAPSRATRRLPMRSTSGPAKNAGRNIPSTCHWMTRLDCSSGRPQKLMASGVAFMIRIINPCPAAVQAMAARTTGRRNRPPMSRQASRAGRGAWPSRSRAISSRPARASTAISR

SEQ ID NO: 30219 - protein, 416 aa, Pseudomonas aeruginosa
SVCAPVAHRLSLVAVRKGAGKRVSRVSQLELADAAARCHRGGVPDLGAVHRGRLDDGGHPPAPQPVRATAGRAPGNDRPAAGGLAGGLPAQPAQGRRCHRALLPAADQPGGAGLRRAVRVAWGAALHPTGRDPGHPRGVLPARPGVLGLRAPGVAVPGPEPGGIPAFRRRREPAYQPAEYALQRPGGADLFVRPVPAGLRPARAVPRPAAAGHDGRTGQPHRPGQPTLLRAARPAGPGAGRPRRKGSGADPGGCRRLQGLQRPLRASGRRCRPAPAWRRAPAGRAAAAGYRRAPGRGGVRRVALRQRGGQHPGHRRAPAAGGGGAGHRAPGLQRRPLPDHQPGGGLFDLRHGPGRALSRGRPRALRGQGCRAQRGARGVPAARPPRIEETKKGARGRLSSYGTAQPWLGILQSCRL

SEQ ID NO: 30220 - protein, 223 aa, Pseudomonas aeruginosa
LDAAPARGDSRPRRAGRDRPGCRPAQATGAGRAGRRAGLPAGILAGAAGRAVAGGKAGDGAFRAIRGALSVCRLGPGFPQPARCRAAGPGQGRASLQPRSAGPAVHHAERRQRLFPYPGGEQLPGWRHPATGRAGAGVRLPDLHGVLPRAPVADPAPCVPVAARSGPRGQRLVAALGLRDLIGLAQVLQPVAVERGDQVGLADDADQVAGFVEHRQAVQAFVG

SEQ ID NO: 30221 - protein, 483 aa, Pseudomonas aeruginosa
EGSFIRLQRIMLLLQCKIIELKRRRTSGAGRTTASWDVRQGGYPPSAMALPAMAGSASLFLLRQQALDQQHHRQDHRAGDDAEQEVQQGRGDRRQHRAQRGDAGDALRGLFDGVVDHRDSVGEDAAADHEHRRHADHRQAFHQVRRGAQDGAAEPLGEAAVALGQIEAGVVQLDDAGDQAVDADGHHQGDADQHQYLGGEAGLGDGTQGDGDDFRGEDEVGTDRAADLLLFQGGHVDIGRQRCLVGVLVVMGQVFVGDLLEAFEAQVGATEHQQRDHRPGREGADQQRGGDEDRLVPQRALGYRPDHRQFAVGVDPGDLLGVEGQVVAEDTGGLLRGDLGHQRDVVEHRGNIVEEGEEAGSGHLGFPYWVVGTAILAGCVFDTGSRRRNSASRWSAGAAAQFIGAGVRARFARARRAMASSASVSSRLPSSSNQAAESPVQARIHCSRRRRCRPLAAITISSWRSKRPGAWAVFASGLVNRLA

SEQ ID NO: 30222 - protein, 488 aa, Pseudomonas aeruginosa
ARRKRRRRPSISGPARPAAPARIEGEEDDEGERHHAAGQAVGLGVFHGFDVIEYLHRDHAGFLRDVAADHQHHAELADGMGEAEDRGGDETRPGQRQDHAEETVDGARAQGRGSLQRFLADRLEGVLQRLHDEGQRVEHRTDHQTGEGEGQGAETEALGELADETVGTHADQQVEADHRRRQHQRQGHHRADRPLQPGAGARQPPGDGRADQQQEEGGERSQLDGQPDGRQVRTVEWQRHAGPALEFVAVGLDQRGGLGALQVVDQGLGGGVVLALVEDDRVLADRVVQLGGNDPGRAGCDFTILVDLRQGDEAQFGVAAGNELVGLADVLAFHQLRPERGGEAELVHRLGGGEAVGRGLRVGDGQVPEAATLQHFTLGVDVAGLGRPECQGADGIGEARAGHDLAFLLQFRRSAVVGGEENLERRAVLDLRIELAGGTVGGNQPVPGVFLEFLGDGLDRRGEVGRDGDLHLVGAGGQGYGAGEEGEQ

SEQ ID NO: 30223 - protein, 362 aa, Pseudomonas aeruginosa
TVPGSASREFPSASRTLLLPAQLPRGARLDRRTLCRSARRSGTCLHRRVRRAARGQPGPAGAHGDAQGHAVPRRQAGLCRDRRHARRRATAVGIGLGGRAADPGTGATVRLAEEGRIVAAVQGPSRAREPAQGCAAGTAPAVVPRGAAARRVAGRLRRTGLRVALHGALRPLAVDVFRQPVAGLVGVCPCRPGYLSLRKRRVFRRLPRLSPARRRRRLSPPVRLPPALRPRRAAGGTARRPAGRTLRQSLAGRAAGQAAVPVRPALRKAAGFRPGPAALSPIQPPRRAPAGDSQPGTRRALRRSPCIGAGGQLCAGKRRRTPGPGPIAAAPARQARPAATGAGGGSGNRPPGPVPGVPERTL

SEQ ID NO: 30224 - protein, 348 aa, Pseudomonas aeruginosa
GNRWSASSVPGTNWPRPRRTTTRPTTSLRRSCSWPCRTRWRRSTTCSPSNRRRWSRRCRSSTSRSCSSAVSPSCSASIRCSTSRSAQAATAAAWPGCACATWCRRRFSPSASPPAAPPCCSPLPLGRATITPTCSACRRARPGWKWTRHSAPSNWRCTYSVGFPRAMRSARHPWRPSQRFSASSFASGRATTWPSSAASITCSRRWTSSARHTRGCRAGARRHGWTRRSAGSSSSASSRAGEGIGFAVLGGAFGEGIDLPGERLIGAFIASLGLPQVNPVNEQIRLRMQRLFGDGYDYSYLYPGLQKVVQAAGRVIRSRSDRGVVHLIDDRFAQAKVRRLLPGWWQLR

SEQ ID NO: 30225 - protein, 828 aa, Pseudomonas aeruginosa
SRWPGARSASCRAPKCAPAPCCWRFIATMWCCATRVMKNVCISPKPKGQKPPMPRCSTRSAQRLSPLFLVLSLAVLGLAPPVHPAPAETAAAQEEEQWTINMKDAEIGDFIEQVSSISGQTFVVDPRVKGRVTVVSQARLSLAEVYQLFLSVLATHGYAVLPQGDHARIVPNMEARQDAAQKTVRDGPGSLETRVVQAHQTSVAELIPMIRPLVPAHGHLAAVPSANALIVSDRRSNIERIEAIVRILDRAGEHDYSIYDMRHAWVAEIAEVLDRSVTPAAGKSAATVQVLADSRSNRLVLLGPPQARARLLRLAQSLDVPSSRSANSRVIRMRHGDAKTLAATLGEIGESLHGERGQDGRGSGKRGLLVRADESLNALVILADPEDVGLLEDIVRQLDVPRAQLLVEAAIVELSGEIGDALGVQWALRSGHVAGGAGFADSGLSIGTLLGALQAGKPPAELPDGAIVGLGSRDFGALVTALSRNSRSNLLSTPSLLTLDNQKAEILVGQNVPFQTGSYTTSASGSSNPFTTVERKDIGVTLKVTPHIGEDRMLRLEIEQEISSIAPTATLAAKAVDLVTNKRSIKSTVLADDGQVIVLGGLIQDDLQRSDSRVPLLGDIPGVGRLFRSSRETRVKRNLMVFLRPSIVRDAAGLERISHGRYRSIQLLRGAAGEPARPLFEDAGAIDLRPAAQVAPAPIGSPRSYPAPAPVLMEKPRLADPASLGDGRGGEVLEVRQGTHAPQPPSPQRYAVRLVEGSSEAFMRALIERHPGLSLRLRRELRDGQELFAVERGDYLDPEQARRALAELPESLPRGKARVIAHTPGSAL

SEQ ID NO: 30226 - protein, 435 aa, Pseudomonas aeruginosa
RPVPLRSRRRGVRPRGLPGGECAGAARQERIPGALERLLQHQPESVADPDGHAIRAVGGAGRARLGGAAGTAVGETRLRCPGPRRVAAVVAALLRFRGIPVAPGGCAQGRRRGRPERGIGRAARSVARGGEGLRRARRQSARRLRADLPAPVRHPGRGTPAAAQPRGPATPGEGRAGAAIQPDAIALAPGLFLAAQRSAFEHRLGLSVLVLRCVLRLAALGQCDLQRGRRPRRYGTGAVALPGTGDPPQRLGDQLLPYGPDPGEQRPAGQRRHQARRLCRQHQHRALRGWQLHRTAPAFLAALQRRLRFPAGRQLRSVPDQRRHQQLRQRLSPLLFLQPERRHHPLRFPSFVQPRPGALSRRGARLQPGSAASETALNSWRVAAAAPGARLTAWAGMLSRAGAAGRRRREPHPCRSGVPGGGRRSDRAPWPGNGS

SEQ ID NO: 30227 - protein, 2736 aa, Pseudomonas aeruginosa
KLLFLDYMVRPFGRCLTRGMSEMSIQAKVTPIDQSISSAAAVEVPENGILKLSQSSNVALDVAPESVAGYSKSGSDLIVQLKTGESVRIANFYAEGQPSSQLFLADKDKLVAVDLPPVAADGPLMAGYIPQESLAGFESLTGAGVLGGMSAGTALLVGAAAIGAGVAISNSSGGGGGGGSSVPPDTTPPKAASGLKIAPDGSSISGQAEAGASVGIDTNGDGKPDLTVIADANGNFTAPLNPPLTNGQTVTVVVTDPAGNASPPAQVTAPDTTAPAPATDVQVAPDGSSVTGKAEPGSTVGVDTDGDGQPDTTVVVGPGGSFEVPLNPPLTNGETVTVIVTDPAGNNSTPVTVEAPDTTAPAPATDVQVAPDGSSVTGNAEPGATVGVDTDGDGQPDTTVVVGPGGRFEVPLNPPLTNGETVTVIVTDPAGNSSTPVTAEAPDFPDAPQVNASNGSVLSGTAEAGVTIVITDGNGNPIGQTSADANGNWSFTPGSQLPDGTVVNVVARDAAGNSSPATSITVDGVAPNAPVVEPSNGSELSGTAEPGSSVTLTDGNGNPIGQTTADANGNWSFTPSTPLPDGTVVNVVARDAAGNSSPPASVTVDAVAPATPTVDPSNGTTLSGTAEPGATVTLTDGNGNPIGQVTADGSGNWTFTPSTPLPNGTVVNATATDPSGNASSPASVTVDPVAPATPVVNPSNGTTLSGTAEPGATVTLADGNGNPIGQVTADGSGNWSFTPTTPLPNGTVVNATATDASGNTSAGSSVTVDSVAPATPVINPSNGTTLSGTAEPGSSVTLTDGNGNPIGQVTADGSGNWSFTPSTPLADGTVVNATATDPAGNTSGQGSTTVDGVAPTTPTVNLSNGSSLSGTAEPGSTVILTDGNGNPIAEVTADGSGNWTYTPSTPIANGTVVNVVAQDAAGNSSPGASVTVDSQAPAAPVVNPSNGTTLSGTAEPGATVSLTDGNGNPIGQVTADGSGNWSFTPGTPLANGTVVNATASDPTGNTSAPASTTVDSVAPAAPVVNPSNGVVISGTAEPGATVTLTDGSGNPIGQVTADGSGNWSFTPSTPLADGTVVNATATDPAGNTGGQGSTTVDAIAPATPTVNLSNGSSLSGTAEPGSTVILTDGNGNPIAEVTADGSGNWTYTPSTPIANGTVVNVVAEDAAGNSSPPATVTVDSSAPPAPVINPSNGVVISGTAEAGATVTLTDAGGNPIGQVTADGSGNWSFTPGTPPANGTVIVATATDPTGNTGPQAATTVDAVAPPAPVIDPSNGTTISGTAEAGAKVILTDGNGNPIGETTADGSGNWTFTPATPLANGTVVNAVAQDPAGNTGPQGSTTVDAVAPNTPVVNPSNGNLLNGTAEPGSTVTLTDGNGNPIGQTTADGSGNWSFTPGSQLPNGTVVNVTASDAAGNTSAPATTTVDSSLPSIPQVDPSNGSVISGTADAGNTIIITDGNGNPIGQVTADGSGNWSFTPGIPLPDGTVVNVVARSPSNVDSAPAVITVDGVAPAAPVIDPSNGTEISGTAEAGATVILTDGGGNPIGQATADGSGNWTFTPGTPLANGTVINAVAQDPAGNTSGPASVTVDAIAPPAPVINPSNGVVISGTAEAGATVILTDGNGNPIGQVTADGSGKWAFTPATPLANGTVINALAQDAAGNNSSPTSATVDSLAPAAPVIDPSNGSVIAGTAEAGATVILTDGNGNPIGQVTADGSGNWSFTPGTPLSNGTVVNAVAQDAAGNTSGPASTTVDSVAPAAPVIDPSNGSVIAGTAEAGATVILTDGGGNPIGQATADGSGNWSFTPGTPLANGTVINAVAQDPAGNTSGPTSTTVDAVAPATPVVNPSNGSVIAGTAEAGATVILTDGGGNPIGQVTADGSGNWSFTPGTPLANGSVINALAQDAAGNTSGPASTTVDSVAPATPVLDPSNGTVISGTAEAGATVILTDGGGNPIRQATADGSGNWSFTPGTPLTNGTVINAVAQDAAGNTSGPVSTTVDAVAPATPVIDPSNGVKLSGTAEPGVRVILTDGNGNPIGQTLADGSGNWTFTPGTPLANGTVVNAVAQDPAGNTSGPASTTVDTVAPATPVINASNGSVITGTAEVGAKVILTDGNGNPIGETTADGSGNWTFTPGTPLANGTVINAVAEDAAGNASGPASTTVDSVAPSAPLLSISADGALLTGTAEPNSQVRIVVNGDTANPITVTVDGAGNFSLPFAPPLITGELIAGVAVDAAGNVSGPATINAPDLAPPTISVPEAADTWINAAEIGDGIQVDVTVRPTMQVGQVVTVKFAGQNGYEAEVSHTLTAGDIAAGNLTLTLTPPGGMGPFPEGASTVTADINGGTASTPVPFTIDTIPPATPVLSLVGNILTISAEPGTELTVTVDVGGVTATATVTADNSGLASLNLLTDLDIDFSWDQLLNAQVSVVGRDPAGNPSNTASIGVGTSIEQPVTIGNFGLDVSLNPLNPRFGFSGTTEPDSSVVIRVITPALNVELLPIQADSSGNFSLNLLSPTILTQLGLNITDILNLGSQISFNLVSTDSNGNDSAAYGITLTPNGLSLNIGQIDVNGTSGDDVLSGANGSSEHINGGDGSDLIFNVGTGDHVVAGNGNDTIQITATDFVSIDGGAGFDTLVLANGIDLDYNAVGVGTLSNLERIDLGKGDSGSVLTLTAAEVDAITDANNTLQITGENNDTLNVVGAVNTGTTQLINGITYDVYTFGSTTLLIEDNTVQVVV

SEQ ID NO: 30228 - protein, 724 aa, Pseudomonas aeruginosa
IMEAEKTPDNVVILNHDPIVDPLRQGLLLLCRQLGRPLGDAELVDGMPLEHGRLPLHLVARALRRADITAQVTRQPLRRIDRYLLPALLLLDDGRALVLVGNDGEHAEVLVPQSDGGSQRMPLAELEALYSGTAVFAKCRYRPDGRVGDYASALPEHWFFGPLKRLWRSYAEVTAAALVANVLAVASALFAMQVYDRVVPNAAFDTLWILASGVALAIVLDGVLRIMRGHLLNVLGKRLDLQLSTLLFSRVLSTRVAAKPASMGAFSTQVREFESVREFFTSSSAALISDLPFVAIFLLIIAVIGGHVVWVPLVACVLMILPGLLTQRLLGHLSRQNLREGAMKNGVLLEAFEHLETVKATRAEGRCLHQWETLTGELAGTAMKTHTLASTLSYSASIVQQLCYVGVVVFGVYRISEGAMTVGGLVACSILASRAIAPLSQAAGILGRWQHTKVAMEGLDQLMSAEQERPQGKRFVHKERLQGHYRLEGVRMAHGDSPPVVDVQALNIRAGERVALLGGNGAGKSTLLRLLSGLLDAQAGRLLLDDVSLTQIDPADRQRGIGYLPQDVALFHGSLRDNLNLENAALGDEELLETLDGVGLGAFVRGHPLGLDMPIQGNASLSGGQRQAVGLARVLLQDPPILLLDEPTAAFDQGSEKQVIDYLQQWLGKRTLVITTHKKSMLALVERAVVLRQGRVIMDGPLEQVVQGNQVQAPQAAEGGNHGL

SEQ ID NO: 30229 - protein, 420 aa, Pseudomonas aeruginosa
PRRRRPAPATGRPVAGGYPPGLPAAALDPARLRAAVHRLGGLGATGRGDPRRRSGRAVQPHPEDPKPGGRHPRPPAGEGGRPGGSRPAAGAPRRDALPHQLPGVGEPGQRAARGHCPARRRGARQEEHRVPAGRRSRGAAGAFRTRAVQVAPRQTGGGHPGDPAADPPGAEPARPGSPAGGQACGEPDGGAQAEPGHRHPQRQADRAEKHLFPGCLYRARTAQGRSQRPGTDRPAAPGPVAPHRDPVASARAGEHRADQHPRRGDPARRADHGSDPGRGASAGGGEDQAARRGLPGSRHAGQGEDHRLRLHHLRRPQGHPGADQCRHHRGGHPAWQGVLLPGADQDRWQPVEARRGGIADHSGDGRRGGHPQRQAQRAQLPAAAADQGAPLLRRAGQARSVETCQPLPCSHGELRRRWRW

SEQ ID NO: 30230 - protein, 448 aa, Pseudomonas aeruginosa
RPPGRHALSAGSGTTRFPSFIARGRPCREAENGVDLSLARRCLRNRLGHGHEGVGRLHPPVAKPGHPAVHDPQLRPAGRFHENPAPRHGLHHLGRHRCGRRLRPGHPALRRKPEPVAAAGGGADRGRHRHSQAGDPAGLRGDHHVRILRSRDLGLARLPLRRARPLPAHAGVGPGAGRPIAWPGEEPAVRVGGGFHRLVALALLGQVRVGRHAVRDLRHRDAVPLPLGGVATGEWLGGFRRGDAVRLPAAGRTVLPAPGRRPRLVAGAPAEKAARLVVEDHQQVAAGLPGGGEGHRAVDAEVQAVAALQVERLLAVIHPQRTLDQPQALPVGPAAPAGIVEAGVRRDLHFHHLAAAARIASADLAAAVAAGRVFPHFLLRAPAERFGRRLRVAEQLGEGDPQAAGETAEDAGGGAALVALDARDHRLAHRAAFGQLGEGQLALLAQGG

SEQ ID NO: 30231 - protein, 1026 aa, Pseudomonas aeruginosa
ASGNQFVDIHEWPWRIFLVHDSHCPIYWKFALALELARDDRTDDSPPGWRGDPGAPGRTGRGTAGLRGRRGFGQLHVAVAAGAGAGLLARRRRERGGRRTPAAGGGSGGADRRYRATAPRPTAEPVAPRRRGEDAGAPACASARHRRGADGRAGPARPGLRQVPAGAGYGQRQRRRTAVPEDRLDTGRGNPGLRPDAGRHALSHHLFLQAPGCCRLTEDASVPKAGRVESADARDSGSMVELLQGFVLTRHWRDTPAGTEVAFWLATEQGPRQVRLPPQPSVAFVLAEQRGRVESLLAGETGAELRPLALRDFQQRPVLGLYCQQHRQLMNLEKRLRQAGVEVFEADIRPPERYLMERFITAPVSLEASVEADGSLLARRLKPAPDYRPRLRLVSLDIETNARGDLYSIALEGCGQRQVYMLGPANGDAAAVDFRLDYCDSRAGLLERLNQWLAEHDPDAIIGWNLVQFDLRVLHEHAQRLKVPLRLGRGGDEMGWREHGSRNNHFFAAAAGRLIIDGIEALRSATWSFPSFSLENVARTLLGEGKAIDNPYQRMDEIDRMFAEDKPALAHYNLKDCELVTRIFARTELLDFLLERATVTGLPADRSGGSVAAFTHLYMPLMHRAGFVAPNLGEKRPEASPGGFVMDSRPGLYESVLVLDYKSLYPSIIRTFLIDPVGLVEGLRQPDDEHSVEGFRGARFSRTRHCLPAIVARVWEGREAAKRERNQPLSQALKIIMNAFYGVLGSSGCRFFDPRLASSITLRGHRIMRRTRELIEAEGYTVIYGDTDSTFVWLGSPRAEEEAAAIGRALVARVNDWWREHLKEEFGLDSALELQFETHYRRFLMPTVRGAEEGSKKRYAGLVRRADGGEEMVFKGLETVRTDWSPLAQRFQQELYLRIFNRQPYQDYVRDYVRRTLAGELDDLLVYRKRLRRRLDDYQRNVPPHVRAARIADDYNLERGRPRQYQSGGWISYVISVAGPEPLEARRSAIDYEHYVGKQLQPVADAILPFVGDDFATLVDRQMALF

SEQ ID NO: 30232 - protein, 154 aa, Pseudomonas aeruginosa
QLSLEDFHEARPAAQRGLHLGRVAVRRRLPDQAHEGIAPRAVEVGGLPVQPLVDPRARRRLLRIEAFAGIAVGQVADDAVGFPEHQFAVAQHRHHGVRVEGEEFRRVGVAEAAAPVFAAVGQVQFGAGPEHLAHVDRRGLSENLQHGDGASLGG

SEQ ID NO: 30233 - protein, 290 aa, Pseudomonas aeruginosa
RTMAPRSPMDAACPRASAARPSARSAGAPPAGAPGVAQGRGGGRDIATGTGRSASPGDSRRPGAGRRRPSRPGRRPGWHRPPRRRRAPRPAAPPATGRRSAARVRSPDDPLLHVGFGTGREADHAEDLVAAADVGDEVVVGPGVAGHRHAREEIRGDAALPAGYQAGFRIQAQVGGQRADHVEGQVDHVRVLARRFQVRVQRRSRNPRAEGAEHVVDHRVVGLRHDQRRQPAVALADLAQEELVDPLEQAGAVVAVDHHRRPQVEEACRAADEVLRAQDADDPFALRVGR

SEQ ID NO: 30234 - protein, 163 aa, Pseudomonas aeruginosa
TVHLAWRRRSLVTGSRFGCRASGRSRRTSRTAPSGSDRRPARRSCRSARRRVFPSMRTRRPGRRSWPRSARATGWRTISRRAAGATGRSIPGPGSPARSGRSRPVPGAGRSRRGPGASRPRRRTSRRKSRSRPGRAGPRRSARAGARPCRGNPRGSRRWRGCG

SEQ ID NO: 30235 - protein, 206 aa, Pseudomonas aeruginosa
NFGDAPKRATFARKKLHGNFSGLSSRCLLSGMDASRFELAEIRTMREYQRLKGFTDNLELRRRNRATVEHYMRMKGAERLQRHSLFVEDGCAGNWTTESGEPLVFRGHESLRRLAEWLERCFPDWEWHNVRIFETEDPNHFWVECDGRGKALVPGYPEGYCENHYIHSFELENGRIKRNREFMNPMQKLRALGIAVPQIKRDGIPT

SEQ ID NO: 30236 - protein, 297 aa, Pseudomonas aeruginosa
AFRSRRSNAKAFPPEAILEGVNYGRSIATRTALRSAAATRMGRSVAPARRAGVHARQSGADPRRRHPGPARDPGAGRPRRGAGGAVRRLRRGHGRPPCRERGAQGCRVGTDGRRRAPGRPAAGDPRRAHRRAVRQAAFQAARAGRRADPAGLSRRHGQRPRGPCRTAPGRSAADPQGLCGGAQHHAPPGLGRRVRAGGECLAGLDQPRDAAARLRPVDAARGRAAPGLSRFDPLAVDRRAHPPGRRRPCGAAGRGAQPGGLQGRPGNRPRPVAGALRAPRPAPRAGAPDADRADGRA

SEQ ID NO: 30237 - protein, 361 aa, Pseudomonas aeruginosa
VGAGPRDWGTHWETLSGGVLPGAARGPTPPEPDTARGERGHFLGDERHQAGFVAAGRDDGVAVHRVVQPNHRVAGRAHRFHQRRQALADLMRAHPRDQRQAPRLAARVEALAERQQLVAADFRADLAGHRVEHLGQQRHMGAVDLAGALADPRPVGRTEIDPALLVLAQHRQVVVEQQHLVAGPDRRGIRLLPGRGVPAQVAHDVARRRIALEDPLRIGPALFGMGLAAVDHVAAIDRQGLLADLLVRLGTRLGVLPGDAPDADHRPPAGQAHGAGHQFQHGSLARHVLGMVVVHVLGAVAALHHQRLAAGDPRQGRAQGQDVAGADQRRTAAHVRLHVAQARRIAPFGLLQRFAAPYALQ

SEQ ID NO: 30238 - protein, 652 aa, Pseudomonas aeruginosa
GRGDKYDLLLDRSGAIHLHAGTVGSRLEIAQGEHLGGPGDLPQHRPGVDRPARRHHLEQMDDGAQPAAHLGCPATTAGRLRRLLRQHLRHLLVASRAPRQRHALAAVPPVAPRAATHRGIHLLLQASDRDGLQLAAGQLRRLRGDGHQHRGRRLLHHVRRARRDVLPLEPAHPARPRLPVPAPGDAPHPPPARPPRVQLQRLPDLGHVVRHLREPPPHRRAAGLRRRQGAAVRRHAAVPRRAQPPRKNPARPRPGQARRQVNAMIPDIDSRLSRNILKSISYGLPLAEVVPDHTYAQLETRLGELKRRYLELRISHGARELPFSNYLFYLILQSRHQEFDFKLRQGNSVVTNIHRFKSKGRIPSLTTLLLADAVNAKSELELKHPDIPQLDRHARDIERWLAAGNVMPPSERALRGLVEALERAAGEGRPLHLVSAVCPDYSHSSDAEGKPRYTFERVGDQPGLAGAKLVSAGQAVAELARARQVEIRHAILGGEFEYLSFNRNPATGETREGFLGKVERQLERIAGALPCPAATCSFFEMCGGEDGWHRAHGEIVQRLEQGDYGQTGLDYPALESIFLSRLPLYEKWFASQSREQIWASFVSQAAEYALMGKLFGERFDNFVVLAVDHYRMEPFYSFFATVPTLYIRTDYL

SEQ ID NO: 30239 - protein, 430 aa, Pseudomonas aeruginosa
RGSACAMQDELFKTRYSKYGYGIDVRRTYKDLPCQPFWTWVTGKSLNDRPPRRPKDTLLKPWQLYLHISWGYAVFFLAVIYGQQLLASQQPLWLKCLLGALIMCLVVNRQRGFLHTFHYTTHGASLENKALARFTCKWILSIPILHTPRDEYVKLHVNEHHSVRTFNTEHDVDLVFMKQHGFYKGMSESAFWTRLVLAPFHPARILEHLKFRFDVSFVSAPRHERVSRALYWAALLGLVYASGYLEAFALFYLFPIFILTQYSSWIQHVSEHLWFARNEHGLPRFLHYGSLSWGRFLGRPYPADKQGLAFALAFVRWSLGVLLIDIPLRVFSFMQDLPSHDFHHRKPGVNFWRIAPERAANEARPSKFGPMTETWGMWENFLILRDHLCRGQSDPFGIVDWYRENHARLAPETDAANQPHTNQPASQATA

SEQ ID NO: 30240 - protein, 405 aa, Pseudomonas aeruginosa
SHRKPHEYSDCPDHPEPGSQRLRLYHPQRRALRRAGLGTDEPGPGQLDPAVGEDPDRRRRRGERPLRGPFHDRPRPSHGGQPCAVGADHPARLQRQRDEPVPQADGRRRLLRPAHAGEPDEGRLVHRPAPGYRQQPGLPVLHRPAARHLLLRRPVRGLRPRRQPAQRHQAGAALGDHQRLQLSPRGPAGDRRRARLAGVLRQSPCGPEPAGLLTRRRGDSKRCRRTHVTPGACPSAACCWGYWPARSTCWPSRWASSTARSRSAMAWNTRGGSPGTPPASRISARRAWRTAISCSATATPGIACGRWSSPAAMPAGRSPKCSASRPCRWTGSPAPWASDAPPRASTPTWTRPRASCCNATATGSTPIWSWPRRRCRWNSAWCATNGRGPGGRWTACPCTCSIPGP

SEQ ID NO: 30241 - protein, 159 aa, Pseudomonas aeruginosa
SPSPGPASTVTTRPSRACWRSTGPKAGNSSSTPPPTSAYRRRTWSMPTSRATSATSPPVAYRSAAPTTTSMAWPPRPAGRAATTGSATFRKAPSHAASTPAKGSSPRRTSASCRPTMPSTSATTGSCPTATNASASGSAAPASAPWKTAWSCRTTSSPA

SEQ ID NO: 30242 - protein, 475 aa, Pseudomonas aeruginosa
RTTRAATTSASTSGAWTTATRPTRSTHGSPRPCGWSSTWRTSTTRATRCPPAIPACRSTAPPISTNSGPAARTSVSPTTPPTRRTASWSCALQPLPPASHDHDQRSAEKRLRPRLLQPRTAVPRGLQAQDSRRPARGNAAVRRAAILRQPAGYLRDLRPPGASDRPGGRTDHRHPGREGLRPRLDTLPLPVDGDGGRPLPPHQPVQADQPVLPAPGQRAQRRAAAADRGEDLQPGGLQHVPRPQRADSGSDAVPGPGSAAPEPGHGRPGPRRGRHAVRQPAPGCGNRPDTRRATQRRPGFLPAHGDVQPRQDQRPLRRPRRQQRPDPLHGPPRARCRTLRAAEDHPVSGLAQRSDDPWLAALPAAVLYGAWAAYANQDGGLAGMGVAALLQGAASLLATRFGLYLLQCLGRRHGLAQRQAPLLVVLLLTAPMAALHWLSGTPHPLASVAPSFVIGWLYFALWARHRPGRRQTSRA

SEQ ID NO: 30243 - protein, 509 aa, Pseudomonas aeruginosa
QHPAGDTGTDSARAYRPACVTGSDRSSSGAPEKNLHAGIVMKILALLAACLLAGCAANAPLRDDSESTCADMRPCSDSYYERHPNYEIGFVEYSERGNDFAPARTQRLIDQLKRYSARGDIAMVVFIHGWKHNAGRDDGNVASFNKALANLASSGVLGKRRLVGLYVGWRGKSMHGLYSENLTYWDRKAVAEEVGRGGVAELLAQLERIDRKDRNYLVIVGHSFGGAITLGALHDPLLERLLALQDGQRIRAFGDAVIMLNPAIEANQGLLLKENSLKVGALGARPPPLLYVISSHGDSATHFAFPLGQWVGVNLTWSQVDLDRTYNGTRYRLREEDLDTTALGNYSLYRTALLIDRECPLPDGSDNCAPRPPEPRVIDDTDIGKWRFRSFCSADGGNADPALPRMPCYSNEPVNFIYTSQSFIADHNDIFNDQVIAFMATAVSKAIYERTAGASYYRECHDPVRKNFSFGKCFDFHYLKATAMHRRLQRQLSEPGTRSEQDVLYENPL

SEQ ID NO: 30244 - protein, 270 aa, Pseudomonas aeruginosa
PAPDRLRRRSARPADGARRQRRRRQGHLLRLRLHPVSGSGRRRGLLAQRGLPPARYLLRPLRQGRRPLRQRLLRAKRKVRSPQHEQAAVRRQAAGRHRRTERQQPPVPRGGRRLPGIREAPGARSVQWPGGTGHLPEGHAIGAQRSRRRRPPRSHPSATEAGPDRRQGNPLRRRAYRHPTQQARGIAVDQRLGHSRPAAQPRPGTAAPAGPAAHPPMSLRIVPSAGRPKWRNRRRRTAGWRRPPAATACPRSARSRWPNAAPRAARDRRR

SEQ ID NO: 30245 - protein, 576 aa, Pseudomonas aeruginosa
SAPSGSAPAAGYRPRTPRRRPGASVSPDSSVGDAAGSTGRAPAAAGSRAAPAAAARRQSPRRAGTRRARAARRGRTPPTAAAAAAPAAGPARSPARTRLPCRPAYRASAGSGRTLAVTPPSTPNLSHPPILPGLPWERWHLRSAGSSQALVEIGGGTGRAVRHQGVVRDFPDPCPAGLQVQPFGGAAADRIQHQQGLAAGPGEPVQLAHQRLADAAPTRTPVHQHLRHVGAVRLVRRLVEEQLHGTDDPPLRFRHQQQAFVARHALADAAPEGQRPLPRQRPHEADRSPAFHAVQQYLGQFVQARQDLLASQAANRRFGHRGQAPMQGRISNILDSDYHGREKSARATHGYRRTDCPTPSRPAQGARADPRPTGRTLRGEQGDDLAHRAQPKQPHRQRPRPSRRRPGGRPLRAARRRAGAGRTALPARAAGSVGRPGQRLPPPPGRRSRSAQRLRDGGSGDPGERPPRLSPLGRPALPAAPVAGRGCAAGGLRRAIVPPATRRPPGLRRRPRGDLRHRRASLPLPAGDPPRLVVRLFPPALRRPVEGADPVQVEQSDQQQGDEQRRLDETRPAILP

SEQ ID NO: 30246 - protein, 735 aa, Pseudomonas aeruginosa
RPDAMNSKIDLSNALPGSRRGFLKGAAVVGLTIGFQWSGARRALAAALPDAGFAPNAFLRIAPDDSVTVIAKHVEMGQGAYTGIATIVAEELDADWSKVRVESAPADAKRYANLAFGTMQGTGGSSAMANSWMQLREAGAKARAMLVEAAARQWRVPATELRTRDGFVEHPASQRKASYGSLAAAAAELPVPEKVQLKDPKDFRLIGHQAPRVDVPGKTDGSAQFTLDVSLPGMLVALLQRPPLFGATVKSFDATATRAIPGVVEVVQVPHGVAVVAKGFWAAKQGRDALKVEWDESKAEKRGSEALMAEYRKLAEQPGKPARRDGDAAKAVAGATRRIAASYEFPFLAHAPMEPLDAVVRLTADSCEIWAGDQFQTVDQGNAARTAGLKPEQVKINTLYAGGSFGRRANAWSDYIVEAVSIAKALGANGVPVKLQWTREDDIHGGFYRPMYYHRLEAGLDADGKLVGWQHRIVGQSILEGTPFAAVMVKDGIDATSVEGAANLPYAVPNVSVELSTTQVGVPVLWWRVVGSSHTVYAVEAFIDEAAQAAGKDPYLFRHDLLAEQPRLRGVLELAAEKAGWDPSRPLPAGRGRGIAVTEAFKTFVAQVVEVSVDKDGKLKVERVVCAVDCGIPINPDVIAAQMEGGIGFGLGAILHSAITLKDGKVEQNNFDGYQVLRIAEMPKVEVHIVPSGEAPTGVGEPGVAPIGPALANAIFAATGQRLYNLPFPTSFAKA

SEQ ID NO: 30247 - protein, 458 aa, Pseudomonas aeruginosa
LAAVPDGAGLRGPTGRPGPRQGSAHVRGPRPRRSDPRRHPRRRASGAPGQGRTGTRRPVAADPSSGHAAARSPARPVGRIRARRVRRSPGSEGPGQAGNPAPAHPGRQSGGLRLCLQPRLRPSLYRPRTAVQDPARATRRQDPTAPRSSARCLACARPGSVTSATAYVARHGYREAAGTFPPTGPVLHASVKARLDQRPQQVVEHAALAAEDVHLGDHPRNDRQYLLAALQLAAIGLDQHLVVGLLAMRGVLLDGVGTDLLQGALEVAVDGVVVGGDLHLGRHAGNQEGHVARLDLRLHQQTLLYRDHFHDRLAGLDHPAAGVDQHGVHPPAHWRQDLGAAQLVLALLDDRFQGAEIGLALCALGIGILEIGAFQLGQLAAEGGDVLAQLERLHLAHRTLGHQRANQVELALRQVDLPLDRLGALHQFVAARLEQLAFGTRQRPLGIDVRRELDALLA

SEQ ID NO: 30248 - protein, 115 aa, Pseudomonas aeruginosa
AGAAGSTCRRRCRRAAPPARRRGCSGPARRPPAGCRRGPCARPPGGNVPAGAPCARSACPGVAPARRSSVGRGLPSPPWCAASDRGCRPPATAVRWPARRGSSRPPGRRRSSRPR

SEQ ID NO: 30249 - protein, 153 aa, Pseudomonas aeruginosa
CCCRQALSSGRWPPSAEWCPGAPKNRRRHRRRCCWKSPPRRRWPPHRPAAQSLRSCHRAHRRRSATRNRPGFPAGCSRPSAARRQRPAADLPPPACPCRPGTVGWKAGLPHRSWRSGRFPRSSAGRSGPNRSSSIPPPTPVRHRARHYCSGRV

SEQ ID NO: 30250 - protein, 397 aa, Pseudomonas aeruginosa
HFPAPRSSSARGDGKTTPTVPTESIAGHPAKRPSSSCNQSVIVTMPSYPTDPLPRATMHHGISPPQDADLFGLIYGFRFRPGEAGREIDSVTALACLRQAREEAPDEFLWLHLNLAHAACERWMKKHLELPDYFFESLREGSRSTRIEHVDSALLAVVNDVVFNFGLVSSDVATLWVCARGRLLVSARAQPLRSVDKLRSSVKHGEPFRSPLQLLIHLLRDQGDVLTQIVRETSVAVDRIEDQLLALRLSANRADLGAMRRVLVRLQRLLALEPGSLLRLLNRPPEWLQDADLRELREATEEFSLVISDLTALGERIKLLQEEIAAKLNEQNNRILFTLTMVTVLALPINIVAGFFGMNVGGIPFADDPEGFWIMLVLVASFTFLAGRWAFRKRGDY

SEQ ID NO: 30251 - protein, 273 aa, Pseudomonas aeruginosa
VDRPPSAGPSMSLSPADLKQLQAAKNLLENPGLTAQLTSLLGTPIEYGLKKLPRKVNEKLGSVIEGALLKVARSATATLQENASGQPANRLHTLGAAVSGGVGGFFGPLAMLVEVPVTTGIIFRSIADIARSEGESIRDMDTLMACIEVFALGGKSASDDASESGYYAVRTALAQQVKAAADFLGKDAGSKKAAPMLLALVRKVAERLGVQYSEKLAAQIVPIVGALGGAAINTVFMNHFQAMARGHFVVRRLERHYGKDVVRDAYALLPRRG

SEQ ID NO: 30252 - protein, 412 aa, Pseudomonas aeruginosa
ACRPTRSAWRRARRQRRASCSAPFRSRRSPAGAGPRADSERQAGVVQRTESAMGGAGALVVEIVAATVVVVVAGADVDPVRTEAGALQGNEGAVVEQREMQVRSGGAATLAERGVDVAGIDAELGVGADLLAVAHLDLVHMVVVGRPAAGVGHPYLAARQHPYRTGVGGDHAVGRTAPARPVVGRIEGRVRIARAGVRMRSVGLPGIALAPGQLHQVGWRRQRGLRLELPGHAVARLQEFRGRGAEQALEGLRVGAERIAALHGGGLRPLSQQTEQRGRCRVQAVLADGLARSRLAQLVFLETVVAPRQLLQHVADLGIEAAFRRQPSQRRRQGALVRRPQRPGLHDHQGQQHFRVDAVVAAPVLQVFALVAQRRRIHRQVGLEVERLGVATVEEQVVIQRQGHAGQLQLAE

SEQ ID NO: 30253 - protein, 193 aa, Pseudomonas aeruginosa
SMAWRTVSIRSASSSAISTPNSASRAMTSSTTSSDSAPKSLRKSLSSRMSHSSTPNRAATSFLTLVSMSSMHCGPTARPWKKVRLLKPPSPPATTARSGSGAALERGRRSAPDNPVDGARREDSKSVTGRFPAYAQSPAPSLAAGFRAVPPGPGVPAPGRGSRPAPPRTAPGHRAVRGANATTGPDAARSARA

SEQ ID NO: 30254 - protein, 201 aa, Pseudomonas aeruginosa
PVRRNRDCRGRLSHRRAALPAACRPATRPAGCRWTTRCRRSQRRRRHARYAAPIAPRGRRRSRRTARRSPPPPAVARAARRAGGRCPRAGRHPPGRRGSPGHSAIRRRAPAGRACRFPGHPGPARRAAIRRSPRGWRQGSWRRHGACGSPGCSPTATRGRRATAPAAASALAPAADRAGPGGCCGCRQGPGRWRRSSRRPG

SEQ ID NO: 30255 - protein, 500 aa, Pseudomonas aeruginosa
AIERLFEQFLAKQFPVDEGRLQAELVAVATADRVAVAAVLQPSQAGLEQGGAALAEVGAVQVRRRAVEGMEERPRNGGEDRLPAEQSEQRIDQAVLDVVHRAIGLFQVLADRPLDATGFARERQAQVQAVDFRSRRPRLSRQAELALQARQQSGQALAFGVAFRRTAGLPRQCMGFGEALAAFQAANRPQARAGVAGLAIEPLGQVEIPLLFAVLGELEQQLDPPPFQPGIGVGFARQAGEQFLQRLAEVEALAAIEQVEIGVDVGAQAKAAGVGGKLDAFVTIDTQVGKDKLRPVLPQVAEIHQPQAVAERHAAQLVDRFGEVGLPLGEPPRLGEQRLEPFQQRILAQVRAPEMVPEQLRQFVLLQQAEQLRQFQGRLRVHPAQCQQRLHGGARVADLGIGQLAFAEQRALAHHHAHQQGLAGLGQLGERGDEGTFLIVEQIGIAFADPGEHRAEVVQVVEGFGKRWGIHGKRSLVLFMHTDTSAPTAWQCASDQASPA

SEQ ID NO: 30256 - protein, 384 aa, Pseudomonas aeruginosa
QRNLPRIGPDEEDPPTQPATDPRRRLRSLRRLRLQRRPAQRRRRARRRGEGQRALLLPLQGATLRGGAGQHRRAPAGSLPAIRRRPAARRGATRLRRQQDAHRRRAAARGQGLLLRDHARRAAHAGAAAGTPRRPGGTQRRAHPPVDRRRPAGAAGSVPPAAQPVGDDRVLCPWRLATGAPHRPGRAGRERLPAGGGKHRPPGLRRLPGTPRRGRAASAFPRAGRLSDLRRINFRVALYSKSHSEPLSLRQPRPPTSFAPTGALHDHPPAPAIARPPRQRRIPGRQRRRGAGRRRGQLHRADPGHRQGIRERHRAQAGCRLRCHRPVLYADQERRAVPGFPLRRRQHSGETGAGRRDRARLALHLCHRHPGTLVAQGRLRRRQG

SEQ ID NO: 30257 - protein, 342 aa, Pseudomonas aeruginosa
RVIRSVCFSPVRVMRWPGMKTSCGHACLFSPCRKHRYASAMIALESRMKANSDELQSFVSVVDSGSISAAAEQMGLTASAVSRTLSRLEHKLGTTLLNRTTRRMELTEEGRYFLDQARQILQQMEALEERLALRRQSPAGRLRINAASPFMLHAVVPHIGEFRRLYPDIQLELNTNDLIIDLLEQRTDVAIRIGALSDSTLHARPLGASRLHILASPEYLARHGTPASIEGLRGHTLLGFTQPEHLNRWPVVHADGDRLEIQPDISASSGETLRQLVLSHQGIACLASFMTDRDIQDGRLVPLFAEQMSEYRQPIHAVYYRNSQLALRIQCFLDFIQQRLGA

SEQ ID NO: 30258 - protein, 231 aa, Pseudomonas aeruginosa
RRARRRGSAGGQCRRGRPGKAEDRRRDPYRLHPLRGNHRHHPGYRRRVQLHHPGTGAGRHRPGDDHRRLRPGRRHRQAGRRRPLSVQARQRLRPRARRRHPAHRAVPDERPVGGRHGGDVHGRRRHPHPRNPGGPPRHRTGRAERRRHRHAGPDAGGDHPDPAELPVRHRRRRGGPGGGAAGQAPAAEEEKDWLSLPSPAAPSRRADSRPGAHPTKRLCALPRKSSSVSIQ

SEQ ID NO: 30259 - protein, 499 aa, Pseudomonas aeruginosa
TDSIIQGWMPPARKCLTGPATAPFFRFEEFHERLPQHRRTHLAERLPPPDPERSTARLPARRTRCLHRRARRGIRLPGVVRQRTGAAPGSAARRIRRTTVRPRLQPPGATLVDARRQPGRRPGRRPQRLLVRTRSGPGPGRHGPRHAADVRPALPASAELRAGPERGPQPVPERTRHRRGLADPALHPGADRLRAALQQPDALSLPAPLPVAAGQSPWHPRPGAERAYGLLRPGPGPGAAGLRRIRRHHPRRPRATDPPYRALRLAPAHGRADRGTDHVPRRADRQHRDLHRRRLEAVAGTPSEGPAGARRASAAGRHRHPERPAQALPPRRQPVQAPALPARDQAEDDHDHPGGLRTGRHPRRRTGLAAIRRRPALPAGAQRSRLPGRHRQPDRPDRRALPQLAAAPGPGRSDHVVPALRPVAVLADHFAQQLERMAQGRRQALAGVHHVGRVGELRRLLDPLQGAAIQVAAHHPGTEITAAAVLHDVLQGQRTEVAG

SEQ ID NO: 30260 - protein, 550 aa, Pseudomonas aeruginosa
SIALAPACWAVHAFRAPPTPIRSSLPACCNRHAKNSATTATTCRTGVCPAKAEPFHTTKGAHGRLFSFPLFEAVVLPERHAHRVAPCILGLVERAVGLAIERVQAHAGGRIGHPQADGQAGAGAGAQVLDAQRLHRLPQALGDGQGVALLAVVEQHGELLPAQARGDIQRPPRALPEHDAKLAQGGIAGRMPVVVVVGLEVVDIHQDQRHSLFFAGALLQGPLGEQLVVASVDQAGEAVLFGHHAQQPPAEELLALGVVLQVQGERTDQHHQAVVERIQQVGTQVLFAAEKQEYRQVQGQAQQRQAHAGPERQAEREEHREDAQGRAQLGEARHPMPLEQHVAGQHRQVDQQQAVGRDGIADLAQAGQEGRRPDHQQQADHSQAHAQQLLEQAGVQADVHHHPVGHDEQRPDQERHPDGSAPLHQRVPAEKLAKLVFQLLFEPQPTKAGAQLARIRIIRQTSLYQAVACKHADSPTSDRTLKQAWTTIPWRLCSDESKSHHPLPDNRACGVPRRYQPSAQRDAPGERMARSVGRLALRPGPKDARLPPSP

SEQ ID NO: 30261 - protein, 337 aa, Pseudomonas aeruginosa
GCAMPEPRLIACLIYPDVMSLDVTGPLQVFASANVERQRQGLPPFYRIQVLGERSEAVPSSAGIRICADLAWRDCPPESLDTLLVPGGLGVEAQTRNADLLAWLKAAEPCIRRLGSVCSGALILAAAGVLDGRPATTHWADVATLRQGFPGVHVQGDRLHTYDPRCRDGDAHIFTSAGVTAGIDLALALVEADLGRSLALSVARRLVMFLKRPGGQAQFSAWLTPEPSRTPRLAALLEWIPANLAGDLSLEALADQACMSPRTLSRVFLQELGVAPGRYVERVRLEAARALLQDAQASIATVSRLCGFGHPENLRRTFHKHLSVSPQEYAERFGMLT

SEQ ID NO: 30262 - protein, 246 aa, Pseudomonas aeruginosa
HCSGRYDERGRCRAETPATKKATLRSPLLPYGNASVVGVLLVAVVGHVAHALQFGNTLDQGLLDAILEGHVDHPAALATAAETQHGDVVLDHVDQAHLSAVAGQPGIDLGLQVVVDAFGDRAVLVDHRHLGVRRLDGQLAAHAVGGVVHHRVFEEGLADRIDPGSEVLQGDGGVLDLFLARLAVGDAGFRVLGTRLGDEDTNADTRGALLLQQLGQIRLGSFGNGDGAHGNSSQICRQFTPIGTCG

SEQ ID NO: 30263 - protein, 232 aa, Pseudomonas aeruginosa
LRGNRDMFRLAAPHPRPFACAPRPLFAAFRLLSSGGASVRARRGLVHPFAALAAQRRTRPMKLLAGSFAALFLSLSAQAADCTFTQLEIVPQFGSPNMFGGEDEHVRVMFSNEDPNDDNPDAFPEPPVYLADRDSGNDCRIEDGGIWSRGGVFLSQDGRRVLMHEFSGSSAELVSYDSATCKVVHREDISGQRWAVDKDGLRLGQKCSGESVDSCAKVVKRSLAPFCQTAKK

SEQ ID NO: 30264 - protein, 1264 aa, Pseudomonas aeruginosa
MKFMVRPPPAGKPLPLLCFSPFRPLTPGPSMSSPLTDRSARLQALQHALRERILILDGGMGTMIQSYKLEEADYRGERFADWPSDVKGNNDLLLLSRPDVIQAIEKAYLDAGADILETNTFNATQVSQADYGMQSLAYELNLEGARLARQVADAKTAETPDKPRFVAGVLGPTSRTCSISPDVNNPGYRNVTFDELVENYVEATRGLIEGGADLILIETIFDTLNAKAAIFAVQGVFEELGVELPIMISGTITDASGRTLSGQTTEAFWNSVRHARPISVGLNCALGAKELRPYIEELSTKADTHVSAHPNAGLPNAFGEYDESPAEMAVVVEEFAAAGFLNIVGGCCGTTPAHIEAIAKAVAKYPPRAIPEIPRACRLSGLEPFTIDRSSLFVNVGERTNITGSAKFARLIREENYAEALEVAQQQVEAGAQVIDINMDEGMLDSKAAMVTFLNLIASEPDISRVPIMIDSSKWEVIEAGLKCIQGKGIVNSISMKEGVEAFKHHARLCKRYGAAVVVMAFDEDGQADTQARKEEICKRSYDILVDEVGFPPEDIIFDANIFAIATGIEEHNNYAVDFINACAYIRDHLPYALSSGGVSNVSFSFRGNNPVREAIHSVFLYYAIRNGLTMGIVNAGQLEIYDEIPKALRDRVEDVVLNRTPEATEALLAIADDYKGGGAVKEAEDEEWRSYSVEKRLEHALVKGITTWIVEDTEECRQQCARPIEVIEGPLMSGMNVVGDLFGAGKMFLPQVVKSARVMKQAVAHLIPFIEAEKGDKPEAKGKILMATVKGDVHDIGKNIVGVVLGCNGYDVVDLGVMVPAEKILQTAIAEKCDIIGLSGLITPSLDEMVHVAKEMQRQNFQLPLMIGGATTSKAHTAVKIDPQYSNDAVVYVTDASRAVGVATSLLSKELKADYVARTRADYAVVRERTANRSARTERLSYEQAIANKPAFDWAGYQAPTPSFTGVRVLDEIDLAVLAEYIDWTPFFISWDLAGKYPRILTDEVVGEAATSLFNDAQAMLKKLIDEKLIKARAVFGFWPANQVEHDDLEVYGADGETLATLHHLRQQTIKPDGKPNLSLADFVAPKESGVRDYIGGFITTAGIGAEEVAKAYEAKGDDYNSIMVKALADRLAEACAEWLHERVRKEYWGYARDEHLDNEALIKEQYVGIRPAPGYPACPDHTEKGTLFELLDPQGLSGVSLTEHYAMFPAAAVSGWYFAHPQAQYFAVGKIDKDQVERYSQRKGQEASVSERWLAPNLGYDD

SEQ ID NO: 30265 - protein, 350 aa, Pseudomonas aeruginosa
DARPMRSQDLHQRLADLGAKPLHCGRIVRAWLQGRALDACTARQRAEDFLPLGVRHGLPQVAAELEGIARLHSEHPASDGSSRLLVELADRQMVESVLLPRGGLCVSTQVGCAVGCVFCMTGRSGLLRQVGSLEMVAQVVLARRRRAVKKVVFMGMGEPAHNLDNVLEAIDLLGTDGGIGHKNLVFSTVGDPRVFERLPRQRVKPALALSLHSTRAELRRQLLPKAPPLSPEELVEAGEAYARRVDYPIQYQWTLLEGINDSLEEMDGILRLLKGRFAVMNLIPYNSMDGDAYRRPSGERIVELVRYLHSRGVLTKVRNSAGQDIDGGCGQLRARATQGTAERRIPARQA

SEQ ID NO: 30266 - protein, 564 aa, Pseudomonas aeruginosa
RSKPHSLTAGIFMYVYDEYDQRIVEDRVKQFRDQTRRYLAGELTGEEFRPLRLQNGLYIQRYAPMLRIAVPYGLLSSRQLRKLAQIARDYDKGYAHISTRQNVQFNWPELEDVPEILAELATVQMHAIQTSGNCIRNTTTDQFAGVARDELVDPRPWCEIIRQWSTFHPEFAHLPRKFKIAVNGAVSDRAAIEVHDIGLEAVKNEAGELGFRVSVGGGLGRTPIVGSFINEFLPWQHLLGYLDAILRVYNRYGRRDNKYKARIKILVKALTPEVFAERVEAEWANLKDGPSTLTEAEVQRVAAHFVDPAYKALDDLDESLARLDAEHPGFARWRARNTFAHKKPGYVAVTLSLKPTGTAPGDVTDKQLEAIADLADRYSFGEVRNSHNQNIILADVEQGELFALWGELRELGFATPNVGLLTDIICCPGGDFCSLANAKSIPIAEAIQRRFDNLDYLFDIGDIDLNISGCMNACGHHHVGHIGILGVDKKGAEFYQVSLGGSSARDASLGQILGPSFAQEQMADVIDKIIQVYVERRTEEEPFIDTFRRIGIDPFKERVYAANH

SEQ ID NO: 30267 - protein, 287 aa, Pseudomonas aeruginosa
GPPGGRRPLALAAQGRDPGKRTQQRRRDHPAGPVARARPGPARPRRRPGGLAGRGRGAGKHRRRPRQVPGDRGELPRLYRWPRLQQRAPAARALRLQGRDPRDRRRAARPAVLHAPLRLRRLRHPCRPQPGRRPGQPGRLQRGLPDLGGAAATAVPPPRLTPALTKKPRSRGAFSFPRSRTPQAARTLSQATCASSSRQSANATRVRPASHWRARSWAGPITTEAKQSSGISRNRPSARYPASAAWIRAKCAWLSARRRSPSSPASTRPRLCRMKRAQSGFATTQSM

SEQ ID NO: 30268 - protein, 397 aa, Pseudomonas aeruginosa
CPDAASSRCWASTAKRRKPPGASLPRKSAPATSAISASSGRSSPNRYGRATCCRSWAPVTPSAEVDQHPADQLAGEDLVDRPRQLFEGDLARHLFEVVELPLQRQLVPHGCLDHQRQLHRVHPEQVDPAQDERQHRGLEAGAGGQAAAGDAAAVLQRLDHVEEDVAADGVHRAGPLFLEQRLVDAIGHGGAIENLLGPQAVEELGLLQLAGGGRHGVAELGQQFHGDTADPAAGAGDQHRAMVGAQAAALQLFDAERRGQAGGAEDHRLAQAQALRALDHPGRGHADVLAETAGGVHAQVVAGDDHLVAGRELGHRGLGDHTGGIDAGGMRVLAGHPTVAAGGQRILVVQRGILHADQYVARRQVAGIALDHLRFVNAVGRFRHPQRLEYSHFDLLS

SEQ ID NO: 30269 - protein, 250 aa, Pseudomonas aeruginosa
SSYPRGTFTRRGPPVGSIYLIRHGQASFGADDYDVLSPTGIRQAEILGDHLLNLGVRFDRVLSGGLRRQQHTARAALERLESSGLATPELEVDPAFNEFEADAVIRAHLPDLLDEQPEALHILRHAAEHRAEFQRLFSTIIARWVSGNHEKDGLESWQEFLDKVHDGLRRLLAQASGKDRVAVFTSGGTITALLQLIVGVPPLKAFELNWQIVNTSLTRLKFRGEEVSLASFNSHVHLELLKAPELITYR

SEQ ID NO: 30270 - protein, 110 aa, Pseudomonas aeruginosa
KKGIEPMTTVADIVSTMKSKFNASAAAGLDLVFQFNIEDGDNHYLVVKDGTCEVVQGDAENPNVTLIMDSETLKGITSGETDGMQAFMAGKLRAEGDMMLAMKLGELFPV

SEQ ID NO: 30271 - protein, 168 aa, Pseudomonas aeruginosa
PGSTGSAAPERRARYRSIRCRAIERCAGSGGKASRENHWASSISSSCGTISPDTYSAWKPSISECGNGQFWLPMYSRLATSTPTSSRTSRTTHCSTDSPASTKPARVLYTPGTKRGERASNTSSPRVTRTIMLGDRRGYWCSPHCGHCITRSWSCVCMRVPQLPQNRL

SEQ ID NO: 30272 - protein, 406 aa, Pseudomonas aeruginosa
TRRELVRSHRQQLQQRGGAERVGDHPGHGAEQDDHVEHIDQVAMPVDHHQRRHQQPRGQQAVGRRAVLVELAERLREQPVARRSHRDLALQQDPAIERAQAGDHRPGSHQVVAPVAHQDPCRVGERRGGAGQHLRRHQALHRSDREDVEGRRGQRAEQGRAGNGAARVLDVVGRHGGRLQADERPKGQRRGGGDRLGIAHVRQLAARRDRQVLGIEVEPAEDTDQQQRQQLEDGQQVLHHAEGADASQVDQGAQPDRGDGHADHQQRIRQRRDEHPQVADQGHGDRRVADPGGFPVGPGAQVAGEAAETVAGIGVGAAGAGVDPRQAGEGQRQQHRAGARHQPAEQAEPAERRQAGGKQEDSRTDHVADHQRAAGPEPHAALAGLLSPRHRHPLACRPHSFMHSTV

SEQ ID NO: 30273 - protein, 169 aa, Pseudomonas aeruginosa
PPAACPCKKRSRQHKSARRACLLSRQRGAWTSLPCYGATTMRSAYRIVSDHYAASSRGNLAGMLADMDERTEWTEMAGFPLAGTYVGAAAIGAGVFQALQRDWEGFRVEIERLIDGGDSVVAVGRYAATHRRSGKSFKARVAHVWTVEDGRIRRFEQFCDTLLVDRATR

SEQ ID NO: 30274 - protein, 235 aa, Pseudomonas aeruginosa
RTTCRLLDHRQPRRMRSQLFGVGAQHRGGYPRRIEPTDRADHRPAAAVAFRAAAGQRQAGLAAGHRQVDVGEDLGVEQRAVQVATGVVHAVALAQRIEVVALARMALAGHQQGIQHRAVLGHVRAVLLAQQGELVVDEADIERRVVDDQLGAADEFEEIVGDLAEARLVLQVFVGDAVDGDRPFVDLAIGLQVDVEVATGQAAPLQLDTADLDDPVTIGHRHAGGFGIQYDATHL

SEQ ID NO: 30275 - protein, 459 aa, Pseudomonas aeruginosa
LLRRYLAGRLLEPFRPAEGDATLRLGPDDLVADQRQGAAEQGASRSHARRRAGTGVTPHALLYPAAPAADRPYPVRHPADQLHHHPGRSRRSGGADDRQAGRLRRRFRRRHRAHLRRRRRSRRGRLAIPRRARPGPGAGERDRAHVRLRQVGPRALHDHAEELPAPGLRAELLPRRQGHRPDHREIAGVDLARALEHADHVPGVDPAGDRQGGPPWQRLRHLDQLGDHRRLRHSRLPLRHPAGGAVRRRQLLGLVPPARPDLEQLRPAQPRRQGARLFLAPGLAGNRPGDRQLRHHHAADQEQLPRRDRQAIRGHRPRQGPDRTPRALRARIPQRHAAGDCRPAGCAAGDLLHRFAVDRGDLLPRRPRPAQLRSGYEPRLPGGLRHAVHLHPVRAGHEADQRYRLHPGRSAHRLREPGVIRCACLPSTSAAGPASRATSVAGGRSGCSSSCSSAASAPN

SEQ ID NO: 30276 - protein, 555 aa, Pseudomonas aeruginosa
ACWCSSAKPPATLSTRGNEMSENILEIRDLAVEFLSGEQRQRVVEGVSFDIRQGETLALVGESGSGKSVTAHSILRLLPYSVASHPAGSIHYQGEDLLKLPERRLRGIRGNRIAMVFQEPMTSLNPLHTIEKQLAEVLALHKGLGGAKASARILELLELVGIPEPAKRLKAYPHELSGGQRQRVMIAMALACEPQLLIADEPTTALDVTVQLKILDLLKDLQARLGMSLLLITHDLNLVRRIAHRVCVMQQGRIVEQASCQELFAAPRHPYTRELLNAEPSGAPASNPPGETLLAVDDLRVWFPIRKGVFRRTVDHVKAVDGVNFELPRGQTLGIVGESGSGKSTLGLAILRLLESQGGIRFEGTRLDGLAQHDVRPLRREMQVVFQDPYGSLSPRMCVGEIVGEGLRIHRIGSEAEQEQAIIDALVEVGLDPQTRYRYPHEFSGGQRQRIAIARALVLKPALILLDEPTSALDRTVQRQVVELLRQLQGKYNLTYLFISHDLAVVKALSHQLMVVRHGKVVEQGSAEAVFASPQHPYTQQLLEAAFMAPASAEN

SEQ ID NO: 30277 - protein, 272 aa, Pseudomonas aeruginosa
VADKERTMGFLTGKRALIVGVASKLSIASGIAAAMHREGAELAFTYQNDKLRGRVEEFASGWGSRPELCFPCDVADDSQIEAVFAALGKHWDGLDIIVHSVGFAPGDQLDGDFTAVTTREGFRIAHDISAYSFIALAKAGREMMKGRNGSLLTLSYLGAERTMPNYNVMGLAKASLEAGVRYLAGSLGAEGTRVNAVSAGPIRTLAASGIKSFRKMLAANERQTPLRRNVTIEEVGNAGAFLCSDLASGISGEILYVDGGFNTTAMGPLDDD

SEQ ID NO: 30278 - protein, 408 aa, Pseudomonas aeruginosa
TQATCTGLAFERLAGNRLECVRTEFEIDAFHFEQLGVLLGESVLRLGQDLHERSLVELIKSRDHRQTPYKLGNKTELDEIFRFDFLERLADLLAHLLTAHFGIETDAAARGTVLDDPLQTGESAAADEQDVARIDLQELLLRMLATALRRYRGNGALDELQQGLLHTLAGNVASDGGVVRFPGDLVDLVDVDDAHLGLLHIVIALLQELLDDVLDILAHVARFRQRGRIGDGERHVQQTCEGLGQQGLARAGWADHQNVALAELDIVLLVTLVEALVVVVYRYRQNLLGPLLPDHVLIEDGADLFRRRKFVPTTFRLRFLHLLADDVIAQVDTLVADKDRGAGNQLAHFVLALAAEGAIQQLAVVLAVAGISHSIDPMGSFKHKMKAIVGIFKPTRRPNVSTASIAEP

SEQ ID NO: 30279 - protein, 155 aa, Pseudomonas aeruginosa
AEAISSIISRTRPSSAFSSCCLTTSATIRPSTTRRLACSSNSSAGSWSGLMLPPNCWTACTRRRFTSLPIRALGTSIGLACSRPSMTWFLTLDLIAWRSSRSMFFCTSARKPSRPVSFTPNRAKNSSFSSGSLGSATLLTVTVNSAALLARSRFW

SEQ ID NO: 30280 - protein, 144 aa, Pseudomonas aeruginosa
SSGKVRLSTRSSPAFAPTSPSSKPAIMRPEPSTSRVPLAEPPAKASPSILPTKSMFNWSSFWAARSTTSKRVFCLRRTSSMLSTSASETSACRRSTLMSSRPETVNSGKTSKVAMYSRSLPFSKDLGSTDGEPAGFSFCSTTAS

SEQ ID NO: 30281 - protein, 94 aa, Pseudomonas aeruginosa
STCCATPFATHTRASKSPSSIKATAVRYGSTTTAPGYRRTPGRRSSNPFRAWTTAAIAAPAASAWAWRSSAGSRNGTAAMRKRWKRRKEAPPSA

SEQ ID NO: 30282 - protein, 281 aa, Pseudomonas aeruginosa
QRVAYCLPGPASGVAHAAGQTGRSSPRRTAHPRARPRTEGAEPGGPATAIRSLRNPPRPDSPVRAQGSPVRGFRRTTRGTVARHLGLAADEKKTAGVLACRRGQRRTVATGRGQLRPTPNPGVPPPRPDRLPRRAHRADIPAPGLDRSRRHLPRRQHGPAQLPERPEHQDRRRLPAGARASRRNPLRRVHPATHRQRTRRPGRQRPGPGRHLQSRLRRSERARLPLRPARHQGTSLAATEGVPMRSPYLCLAGTLASLCSAAVAEEWHDSIGPSALVEYRF

SEQ ID NO: 30283 - protein, 318 aa, Pseudomonas aeruginosa
RSYGKSTGRLLCPGRRPCENARPFSTRFDGYPSDMTAQLIDGKAIAANLRQQIAQRVTERRQQGLRVPGLAVILVGTDPASQVYVAHKRKDCEEVGFLSQAYDLPAETSQDDLLALIDRLNDDPAIDGILVQLPLPAHLDASLLLERIHPDKDVDGFHPYNIGRLAQRMPLLRPCTPKGIMTLLASTGADLYGMDAVVVGASNIVGRPMALELLLGGCTVTVTHRFTRDLADHVSRADLVVVAAGKPGLVKGEWIKEGAIVIDVGINRQADGRLVGDVEYEVAAQRASWITPVPGGVGPMTRACLLENTLHAAEHLHD

SEQ ID NO: 30284 - protein, 1046 aa, Pseudomonas aeruginosa
KAPRSRGFSFIAAGSVGQAPGSAALAILQHDAHGGEPIANPVGLRPVLRRPRLQARLDQRLDLGRIDLALGARLQEGFRLQLQHPQQASQLLQARGQRGRRRQVAFAQTIDLPRQLEQHRAGTRGIEVVVHRRGEALDILRRFRRRRLGQPLERVVETVQGRLGLAQVLLRVVDRTAVMAGDQQVTHHFGVIFLQHFADGEEIAQRLGHLLAVDGDHPAVQPGLGVGLAGRGLALGDLVLVMRELQVVATAMDVEGIAQAAGGHHRAFDVPARAPLAPGRRPARFARLGALPEHEIERILLRFARLDPRTDAQVLDPPPRQLAVASELADPVVHVPVARRVGIALVDQGLDHRVHAGDVIGGAWLLVRLEDVQPGLVLVHRRDHALGQHIERLAVLVGAIDDLVIDIGDVAHVRQVVATVAQPAGDHVERHHAAAVAQMAVVVHGHAAHVHAYLVADQRREDFFGLAQRVVDLQHGLSSALSPGVTQGDGTVEHRLARPGVLQVGDEIAFALELEAILRVRLAQRRLGATAGQYLQGVGVDVVEEAAALFRLLRIGRAEQPIVQAHFALDAALGRHPVDHALDLAAFRVLAQGVRIVAAAQFDDIAVGILDRFVGTDHVAAAQTHLATGDQALVAGRRDFLEVTGIDEQLATERQYAHSHVFLRMTRQLEVLHLPFGVVGDHHLERFQHAHGTRRGGVQVVADAELEHADVDHAAGTVHPDHLAEVADRLRGVAAAAIAGQGRHARIVPAADMAFVDQLLELALAGHGVVQVEPGEFVLARLRRYRQVGQEPLVERTMVFEFQGADRMGDALDGVRLTVGEVVARVDAPLVAGLVVMRMADAVQDRIAQVHVRRTHVDLRPQRTGAVGELTGLHAGEQVEVLLHRTVTVRAVAARLGEGAAVFAHFLGTEVADERLAGLDQLDGPGMQLVEIVGGIADLAGPLEAQPLDVGLDGIDVLLVFLGRVGVIEAQMAIASEFLGQAEVQADRLGVADVQVTVGLRGETGDDLRVLAGIQVGLNDLAQEVRGGGGLWLAHGILGHALARPG

SEQ ID NO: 30285 - protein, 252 aa, Pseudomonas aeruginosa
SSRRPKSSKNEAMSVLFISDLHLEAERPDITRAFLSFLDERARRAEALYILGDFFEAWIGDDGMDAFQRSIAQSLRQVADGGTRIYLMHGNRDFLIGKAFCREAGCTLLPDPSVIDLYGEPVLLMHGDSLCTRDEAYMRLRRWLRNPLTLWVLRHLPLATRHKLARKLRKESRAQTRMKAVDIIDVTPEEVPRVMRGHGVRTLIHGHTHRPAEHPLDIDGQPARRIVLGDWDRQGWALEIDANGHRQAPFPL

SEQ ID NO: 30286 - protein, 398 aa, Pseudomonas aeruginosa
RHQSGQRRPRRHHRGFPDRVPRQRRRQGRIFRALSPARRRAVPEDGPGIPQPGQFHPHRTGAGDQGNPPGHRFADERRRLLRRSPQRIRRRVREPAQRRPVPDQAQGSPRAARRHSAPDRDPPGRHRAGSVRRQQRQPVRHREGHRCQGHPGTQATAVPQVRRRGGGSADHQRRSQPAVQAAHGQGPAGARRAGGGAAEPPEGRRGKAAGHRPRREGSRGQAPGNPARPDRTHHPGGNRQAIGGDQRRAREAARRDREADRRTAARQGHGDRPGHQDHRRRRGLRPRSGDQGGRRVAAEARRADRDQQGLGRSRRPGPRPQRNDGRRRQRRGEPPGRDRPADGRSGDQGRPRPGPRPQGQGLIQAAKKAPRGALSCFRLRPPGPPGGRCGSGIRCPDC

SEQ ID NO: 30287 - protein, 295 aa, Pseudomonas aeruginosa
PQALRETIMQAIRSILVVIEPDQLEGLALKRAQLIAGVTQSHLHLLVCEKRRDHSAALNDLAQELREEGYSVSTNQAWKDSLHQTIIAEQQAEGCGLIIKQHFPDNPLKKAILTPDDWKLLRFAPCPVLMTKTARPWTGGKILAAVDVGNNDGEHRSLHAGIISHAYDIAGLAKATLHVISAHPSPMLSSADPTFQLSETIEARYREACRTFQAEYGFSDEQLHIEEGPADVLIPRTAQKLDAVVTVIGTVARTGLSGALIGNTAEVVLDTLESDVLVLKPDDIIAHLEELASKE

SEQ ID NO: 30288 - protein, 265 aa, Pseudomonas aeruginosa
PDHQPRTAGRRRSRLRQGRFPFRHRQGRSHLPPYRQATCRRAAGHHAGRLQHRHPGRAAGRRRTGQHRRRTAEAHPADVRRLPRRRRARQEGQCRGQVRAAILGRWRVVQGQAGSPGKADAHRIQGPRRNQHRRPLPGPRRLVAPGHPAARPGHAEDGPRRHRAGPAGFGRSAEADRSGQGQGLPGRLRRRRGRHRFLAQIRHQLGAVVLRRRHSVRAEQACRRLLLRHQDRTDLLQHHGRCRRPADRVRLHQPGHGRRHRRIPL

SEQ ID NO: 30289 - protein, 308 aa, Pseudomonas aeruginosa
STGAPGTAATPPATPAASRSTPWPKPARASPPDPGAPAMLRILLIDDTPKKVGRLRAALLESGFEVVDESGLTIDLPARVEALRPDVILIDTESPGRDVMEQVCLVSRDQPRPIVMFTDEHDPGVMRRAIQSGVSAYIVEGIQASRLQPILDVAMARFRERPGAACSTAGARGAAGRAQAHRVGQGPADEDEALRRGGGLHADAAPGHEPPAEADPGRRADHRHARHARRLNPAGQLAIISPATLLAPGAERRGYARAPGTALSVLGATPSPPSTSMTREARSGRPGLGAAGVRPNRTADSAVRRCSA

SEQ ID NO: 30290 - protein, 78 aa, Pseudomonas aeruginosa
TAMSRHCCWGCSSASPGHPSPWPCRSHRNGTRRNTRARPWASPARATPAPCSPPSSPPAWPPRSAGTTCSASPCCRSS

SEQ ID NO: 30291 - protein, 144 aa, Pseudomonas aeruginosa
  UNSURE (26): Identity of amino acid at the above locations are unknown.
ALARPAPAGLARKTRMRCGWSPRRRXWPPARDTCWPSPTVSASAPMAAWRRAAACKRWPWITMRLRKPGPSCSPWTACCWRRTAGYRPTAAASRCSPPSPPWCCAAPATPWPTSAIAGPTCGATASCSGRPATTSGNSRTCNTC

SEQ ID NO: 30292 - protein, 92 aa, Pseudomonas aeruginosa
RAERHQPGAIRPGTGQKDRGEAPRYPCKAMEIGNSASWHGACLGSPDNRQQSACLNDEAAFPDRTGPGQRRPAGNSGTPFLFAPTLCRSYSA

SEQ ID NO: 30293 - protein, 118 aa, Pseudomonas aeruginosa
WSATAWPGSVPWKNCSSSTRTSTTSRCSAPSPIPTTTASCCPRCWPASRPSRKSSSTTSTGMRKTASSSSSTARWCRSTGSAAGWSPRTAARPSTTACCWPPARSPSSCRYPAIACRA

SEQ ID NO: 30294 - protein, 161 aa, Pseudomonas aeruginosa
RPASAASSAASARRTRRSWASIWNTTCSTCGRRTRSSWRSPAARATAPRPGSRTSASSAWTPAGRCTSAATAGSRPRSRSSSSSSRPPKRCANTTAPSSSSTARKPSIWSARCITCSGSAWSTSARRWSRTRKTARRSTTACNSPCPSSRTHGSSASNSRN

SEQ ID NO: 30295 - protein, 141 aa, Pseudomonas aeruginosa
RRSSNGFRSSNWKTSESLVRAVPRRPSPYRSEPMNWLDICALDEINPLGSRVVAGPKGDIAIFRAADDQVFALDDRCPHKGGPLSQGLIYGKRVACPLHNWQIELESGEAVAPDQGCAHRHPVRVENGRVLLGLDSVALCA

SEQ ID NO: 30296 - protein, 244 aa, Pseudomonas aeruginosa
AVRSGWWVRVPGDPELLTLKAVRALQDADVVMVDDLVNPSILEHCPSARLVRVGKRGGCRSTPQDFIQRLMLRHARQGRSVVRLKGGDPCIFGRAGEEAEWLARHGIDSEIVNGITAGLAGATACGIPLTYRGISRGVTLVTAHTQDDSPLAWEALARSGTTLVVYMGVARLAEIQAGLLAGGMAEDTPLAMIENATLGNQRECRSNLGELLRDAGRFALKSPAILVIGEVTRDIVSQPISLSA

SEQ ID NO: 30297 - protein, 486 aa, Pseudomonas aeruginosa
SLPACPTGCSSRSASSGSRYRIACSLSLVSRRCVFRGNTGNRRQMRRTVVDADHQRLQPVPHEAEQVTGADLAIGGLQHPSQTRVVVRLGSRSLEQVPQGLFERIVHAHLMSVRGSDALSSPQVTSEPAQPTKYPPLEGGDPADQQAGQPEPMRCIRPWNAADIDSQQAGDEAHRQEKAGDYTKEIHGAVHPFGDSPRLGFLQDADALPYQLEFFEIPRQPVVQLVPVIGVVLDEPGQLVARQLRVDVPLRRQVAPQPRRPAAQGTQLVLVGTGALVRLDQLLDSIELVGYAADQRVDAIGQVVREVVHDLGCCLRPFPRLQVLEQIGHRLQRPQAQRDHPARVGEYPQRNHVFRLRARIQVHSTEEHQQAFGPEIEQTGASRLLQQQIAGELAEPRGIPQPGLRFRHAAVPVQPKAFLRQQVEHRYLVASDTASAAAPVEDVAIDQAALVTRLVRLHCASLGKTTISTVKTQVRYQSIHGLAAQP

SEQ ID NO: 30298 - protein, 230 aa, Pseudomonas aeruginosa
MSSVRSARNSALTRATGKRRLLLCMLVLYRRHEKGRCYPPFPDTARTDQAWSCPSARKNQVSSTESGFSETLSMPCSISQRARSGWSDGPWPQMPMYLPALLQAAMALASSFFTAGLRSSNRWATMPESRSRPRVSWVRSLEPMEKPSKNSRNSSASRAFDGSSHIMMTLRPFSPRFRPFPASSSTTWLASPRVRTKGTMISTLVRPISLRTFFSARHSSSKQSRNDSLM

SEQ ID NO: 30299 - protein, 197 aa, Pseudomonas aeruginosa
PAMRFSTLSLMSAGRPAKFSNALGCTPIMRLMMNSRRARPTPSFGNWAKSKARSGLPTFIMILNGRSGMASTEFLRTSKPSSPSKMKPVSPSAQETVTPWPSCRIWVALPQPTTAGMPSSRAMIAAWQVRPPRLVTMALARFITGSQSGSVMSETRTSPGWTLSISDTSLITLTGPAPMRWPMARPSTRTVPFSFSR

SEQ ID NO: 30300 - protein, 197 aa, Pseudomonas aeruginosa
RRVFRHGLDSDRKIDPPNATPTRTYETQALSSPALPIHRRTRPERSRRKDGLRPERIRAHQRPGHPAGRQARHRRQDRLPQRPRHQAFQARRRNLGALLPGHRQRRRHPDREAPGADQQDQAPPRRLQPRRGQGLYRPSGDRAAGLHGQGDSHHRSEPDRPKCIPIPAFDRLGGLEEIRRTGRSELEILGRETRLQT

SEQ ID NO: 30301 - protein, 511 aa, Pseudomonas aeruginosa
VNDMRSLNLHLKVLIAILLTLGVAITAYQIFVQGIPVTEAETDDLWNIDAKVDFVATPKTPVKVQMFVPPLSQDYVSLNESFVSNNYGVSINRADGNRKVTWSARRANGKQTLYYRLVLTKRYTGEKTKEKGPIFRDSLPLEGPEKIAAEALLAPIRQHSADVETFVSEAIKRANNGNDDNVKLLMAGDTSLEKKAHIVETLLSIAHVPMERVHTIRLVADLQQSPELWLRSFNGENWLYFNVVTGEQGLPSDRLIWWLGDEPLMTIDGGKKAQVSFSLNSSEMNAIRLAKLSDENTEAAFLEYSLYGLPLSTQQTFQIMIMIPIGVLVILILRNLIGLQTLGTFTPVLIALAFRETGLQWGIALFTVITALGLSLRSYLEHLKLQMLPRLSVVLTFVVVMIAVISLFSHKLGFESGLSIALFPMVILTMTIERLSITWEERGGGHAMKVAIGTLFAASLAHILMRIPELVYFIFTFPAVLLILVAFMLAMGRYRGYRLTELFRFKALLKD

SEQ ID NO: 30302 - protein, 328 aa, Pseudomonas aeruginosa
TMSIWKTWKDLTAKGVMGINRRNADYVLKYNKRHLYPVVDDKIITKERALEAGIHVPEMYGIIETEKGIDKLNEIIGEHNDFVIKPAQGAGGDGIMVIADRFEGRYKTVSGKIVSHEEIEHHISSILSGLYSLGGHRDRVLIEYRVTPDQIFKSISYEGVPDIRIIVLMGYPVMAMLRLPTRQSGGKANLHQGAIGVGVDLATGVTLRGTWLNNKIAKHPDTTNAVDGVQLPNWDGFMKLAAGCYELSGLGYIGVDMVLDQEKGPLILELNARPGLNIQIANDSGLVHRCHAVEARLEELKAKGIEESAEERVRFSQQLFGHVQQQQG

SEQ ID NO: 30303 - protein, 576 aa, Pseudomonas aeruginosa
RPPEAQPGEDAGSAREKTQSTMDARIMLQPSEGRTVGHGENIGFHRGVHVQSRVRVVHQVVEPGAVQVAAGIGLDALLGDEVVETDIDHRVLVPLVAQPQAVEIGIADRHQDIRLALGDRRRPVFVAGAQLQTVVDVVLHAHGPAPGIAVAAVEGDAVAGGVLRVEVLGDAQQVELAVELDLELVPVAVAVPFQVEVELPLLERAQLHAGGEGIRIDHVHRGVAMLFVDVPVGEHLAEDRTAERLVHPGPETLPALAVVDPVLALELHPRLALVGRAPGEPVGGLPEHAEVEAGRKRLLHVQVDIGQVLERTDIAAADVEEHLEDLLHSRQATDLLGLLQQPEQLVRRPEILVQRYCLVGETHRQADRQLVVDLVGQGRREVGEPLQRHLASLVARRIAIGIAAVAQRLRGVDVGGEGELGARRVDRDSGQRRHQQRHVGHAAETGQVHGRGQGPAVAVGDRVVAQAEGAFAVVRRRLEAGADVHHPGEQLHGRLAALHPGQRRRVVVHRIDAGLVGGHGVAEGHGFRVADGQVVGHLRAGRRNPGQAHPCQRQPERRNAHLHNRPRSRVTGPSAL

SEQ ID NO: 30304 - protein, 476 aa, Pseudomonas aeruginosa
RNGSRIDDSGELEFLTVPLPPLSMPSCHVHPLPYHSDPSCLFAIIHEAPGAVMLDSGRPIATRGRYDLMSAWPLAELAPLPDESANRFFARLREAAGSLGPAQLPAPYELPFAGGLLGYLSYDLGRRIERIGEHARDDLGLPLASVGLYAWALISDHQAGTSQLVFHPRLDERERQRLIALFSEETQGAAGNFKLLGKFRRSISASDYRQAIRRIQDYIQAGDCYQVNYSQRFQAACSGSPWPAYRALREACPTPFSGYLRLADGAILSLSPERFLKLDKGKVETRPIKGTRPRGKTPEEDMALAASLLASPKDRAENLMIVDLLRNDIGRSCQPGSVRVPELFALESYPNVHHLVSSVTGELAPGKDALDLLEGSFPGGSITGAPKIRAMQIIDELEPSRRGIYCGSLFYLDVRGEMDSSIAIRTLLVRNGQVSCWGGGGIVADSHWEDEYQETLDKVRVLLETLEGMAGTASPE

SEQ ID NO: 30305 - protein, 141 aa, Pseudomonas aeruginosa
SVRPETVDRAYAIGVKCRSNPERRPSMRITMVKKVLANGEDCRKCKEVRQRLEQGGYLPRIHRTLVADERDPNSAGWMVAAQYGVETAPFFVVRHDDGREQVYTVFMSFLHEVLEPRAEQSADADREALARLAGRDNLDML

SEQ ID NO: 30306 - protein, 71 aa, Pseudomonas aeruginosa
HSQGKPEVIMKRNVFAAILLGMATTLAVQASFADESSLMENRMVQLNQHAIEQAQQQQATAPTASDTDAQG

SEQ ID NO: 30307 - protein, 280 aa, Pseudomonas aeruginosa
SRTIDGQRSRKARARPLSKWSWGAMPWAITWAPESRMSPSTSRIMSVSFLASGQALRAPPCIFHRTPCPPAPVDAYQRRPVPSATGRLDCMRGNLGGTSPLHWIPASCRLIHDKETTAMPKWIALCLIPLLASCATCRQDSDREKLLYENDMLQAKLIIVANDRDRLPLAQALLERAARDDRSGEADFYQAVLIARRDGQASDCERITRLLERSAERRYPLANAMLYKIYAEPFLLPRADIPKAETYRQAYAELPVARSGYPSFERARQVVDRLLAPTSS

SEQ ID NO: 30308 - protein, 295 aa, Pseudomonas aeruginosa
RDNSLSNRILLRDPMPIRGIDHGSRHETSQPTPLRPQHRPGHPGSVRHPHAGRVEPRRRRRKRQERHTGQRHRHDLLQPDRPGPARPALGVEQSTRRLNAGFFPGKQHEKANTEILDRRRPGDIDQWLLATRPRPRLGRRTGAHHRMQPGDGPRAGGQPGAEAAERHPAGTPAALDPGALHPRLPGLKRKRRQPREAGGARMARGRLRRRSAGARRNASSIRRRRCPGGPPPGYRPPCDRVPRPGAAGVVRAVRGSSRGRTRDAPGSTAPGRRWRRRHRDRSRWKRSPARFPAAG

SEQ ID NO: 30309 - protein, 188 aa, Pseudomonas aeruginosa
PRRRSATPCANWKPSSASACSTAPLATSRRPRPASTCWHTWTRRSKTSPPRWTALTAFAKRLTAWYESTHRETPSVSSSRHVSANWPATIPASPWKWWRTRVSPISSKPVSTPASASAKTSSTACAPCGSARTCAWPSSPPRPTSDGKAGRVARRNCSATVASAGARCLPESFTNGNSARARKRFRWP

SEQ ID NO: 30310 - protein, 290 aa, Pseudomonas aeruginosa
RIASVIPVLPSHALDDGGDAHAAAYAEGGQAVAQVAPLQFVEQRAEDDAAGGAERVAHGDGAAVDVDLAFRHAHVLHELHHHRSERLVDFEQVDVFHLQAGLGQGLAGRRRGAGKHDGGVGGGHRGSDDPRPRLQAQFAALGLGANEHGAGAVDDPRAVARRMHVLDALDLAVLAQRGGVEAHLPHHLETRFERGEPFQGGVGANELIVVEQDDAILVGDRHQRLAEQPFGAGLGGLLLGAQGEGIDIGATEAFQGGDQVGADPLRDEAGVQVGFRIQCPGAAVGAHRHA

SEQ ID NO: 30311 - protein, 521 aa, Pseudomonas aeruginosa
SARAPAACTLRTASRSAQRRQPPGQQQRNEGERQQGRTQHQAGDLIRRTIAAQGVEIVEHRHRHRRLHHQHPLRQRRQLQRQRHRPAHQRPQQKTQAAIEEAIAQLPRADAGQGHAEGDQHQRNGQPGHQVDGIRHPAWQLQVEPHQQQGQQHAEQDRIAQQRAPGALAAHPEHAEAEVADRHDQVERHRQGHPRLAERIQAHRQAHVADIREAVGRHQHLPLLAPEARRRPAQRSHADADQRAGQGHPAETVQVHPGMRQGGEDQAWRTDVEHDARNELGRIGVSETDPDVTDTGAEQHGRHHGEQLGEHGNPLVSQLCNGPHATARPPFRANLSLHVITGGCTRNPHACHSPAPGVARCPALPCGCRLGRRAPPGTAGGHADLEQRRTAQASAGPRPGHPGRRRLPPEHALPRRATGGVVERRASRRPFAGRGQRRLRRRVAGHPAARRTGLASLAGDRGSAAPLAAAGRRQAVRRAVLSGLEQTRGKTHRSGAMALPGRPHPLPVPSGRTLPGPAAGR

SEQ ID NO: 30312 - protein, 408 aa, Pseudomonas aeruginosa
RVFAEVEADHVRHVGIDRLVVGHPGTDRVGQHQVAGPVGGQQAGHAEQRIRVERQRVEEGVVDPSVDHVHRLRSGRRAHVDPLVADEQIGAFDQFHAHLAGEEGVFEVGAVETSRRQYHHARRFDVTGPLEGVEQQVRVVVDRRHALADEQLGEQAHHHLAVFQHVGNTAGRAQVVLQHVVVAAAVADQVDPGNVRVDVARQVQSLHRQLVLVVGQDLLGRNHAGLEDALFVVEIGEEQVQRLDALDAAGLDVRPLRRGNAARDGVEGDQALGALLVAVQGEGDAGAVEQQVGFTPALQQLLFRGVGQPASEFPIMRAAFAASIVHLVVKHACHAGLLVVTNDGELAKPVPARGSRLVGDSQGRRGGFAPVWCILPTGRGRAPRSTACAPRGHGPASTCRSRSDLWDR

SEQ ID NO: 30313 - protein, 726 aa, Pseudomonas aeruginosa
ARFRLRRRPLVLPDGIGESDSCNNIRLISTTSLPLSRSDAFMLISSYNQVLVAFSLIVAILASYTALDMAGRVTLAKGREALSWLIGGAFAMGFGIWSMHFVGMLAFSLPIPLGYDLGLTLLSLLLAVGSSAFALWLVCQAELPWQRLALGALLMGSGIAAMHYTGMAALLMMPGIVYDPLWLGLSILIAVIASGAALWIAFRLRHGSRRIVLVRAGAALVMGCAIVGMHYTGMAAAQFPLGSFCGAAGRGIDNGWLAVLVIVITLAVIAIALIVSVLDSRLEARTSVLATSLARANRELIQLALHDNLTKLPNRMLLDDRLEHAIQQAIRDDRRFAVLFMDLDGFKAVNDAYGHHLGDLLLIEVAERIRANVRAQDTIARLGGDEFVLLIEAREPADAATLAEKLVKRISQPYQISRHEVRISASIGIALYPGDGQTRHELMINADAAMYHAKDQGRNGYCFFESSMNANAQEQLQLLHDLRQALERRQLVLHYQPKVLAPNGPMVGVEALLRWEHPQHGLIPPDQFLPLAEKTGLIVQIGEWVLDEACRQMRLWLDGGHAEWNIAVNLSALQFAHAGLVDSVRNALLRHSLEPSHLILEVTESTAMRDADASLVILEQLSAMGVGISIDDFGTGYSSLLYLKRLPASELKIDRGFINELAHDSDDAAIVSAIVALGRTLNLKIVAEGVETEAQQEFLTRLGCNSLQGFLLGRPMPAEQLLASVA

SEQ ID NO: 30314 - protein, 422 aa, Pseudomonas aeruginosa
ERSVAASPAAPAATAAIPRAGATRGCSGPGRSATGRPSMASRRSAPLPVPEELRQVARQQQRQQQAEQAEQASARVLRHLDREDTLEAWRQRDLADPGRRHQHHADAVVAESFDAVVHQLLDLRHVGIQLHVGGVLDEHRGRCRRGLPAQSVALLWQHHMDPRHQHAIDLGKGMGNLLGLGVVEPRALFDGRGNQPVLGKHILQRGEVLPRIALALEHLHRLGDIRFLHQQAHGAILVRLLVRGNALRTQQRQHLVTFLLADPGIEFDLAPAQRQDQRQERHARQTFHRSPHWVFIRVSTFWLMRPTVLAISSSCMVMRISDHCICIRLLGSSPGVDSSTCNSCLAWLKRSLICPSSLSRSPPRLPAPPIARSNSATWAAPAGPPESSSRLVICAWAPIREISIMTPGRVCGCCARGCRACR

SEQ ID NO: 30315 - protein, 235 aa, Pseudomonas aeruginosa
AGSAPAIRDAPVAPGIRRPAHARLHRATGGERFAAGVPAAVPHGASPSAPGGPPPTLAAAGQSAAAGARRERRSPTRPGGVRPPAARRRGPARKPAPDRQPAGSPPLDWPTDRRRIPAACRCGSCPHLGAHAGGEVGQGRIAAAAQPGQPAVQRGAQPQVPLAQGEPGLQRRPGIAMGEGQGFLIAPLVGQAGNPDQPRRFVLSEALQPLGDAQRLFVAVLPAAGQRQFRQFAYQ

SEQ ID NO: 30316 - protein, 158 aa, Pseudomonas aeruginosa
ARTFAWGSSPAMPCWRADQGSTSMPSRHSASARLTPSSQAPPARADDLRRTGAVCTSASGKRSGKLRCGSQNAQRSGPQVCPASACRIAPATCAWPSWRGSQPSAHSSRRTPWASTSSTRWTAAMPSSSNTRSACNGSLPSATRPSPSETSAPWFSPL

SEQ ID NO: 30317 - protein, 1073 aa, Pseudomonas aeruginosa
KRIFQAMLIPALRADAPGAVLGTGAVGHPPALLRTHPAGREERTLAGLAQALLFGPGRRQRLAAGATEQLAQRQALVRQLVDFKQAAAQVATVVQRQVMADAIVDQPRLDEEQPHRAAHGVRGSAEQRAEIGNVAEPGYLALALAQFVAVDAADQQALAMAHAGDGIDHRAVDRGDLVQAGAIGFLAAVLDVQAEADLRRIAESHHSRRHFQHGAVGDRLQLGHPLTRDPHIVGFALVEHRLGILLGQQGRPGSDLRLPLALQQGDLGQQEIQPATVHQAADRPVTGAAALLAILAGGADLDRLVVAQANPGAPVDAQLGEVLGIDVDDRQADLDPRRGPVEGFDQAAIHGQPVLVVAHHHRIQRRFRLDHRMARLRSRAQLARLVAHRNHVGIAEHPREDAGDARRLDLVVAVLDLAVLGDRIAQREDLHAEVAGLFAAQGVLLLQHLGGLLDQFEIAPRTGHVHQPPGRVGTPAEARLPDAGGGQRALQLGLADLLQPHQPRLHLGGLEYVQHGAVVVPAEVVEGGHQLQEGLRAFQVEATADLVVDLVADDHRGIVVGAEVGQHVAQAFALRHIVVRQAGPVQRLRAQDRARQQRQQSADQQAAHQGRHTGACGGNPRGSGSSSGASASSSPTWGGQGPFESLGIEAVEAQPRLQQQAPVRVQDNGLGIAPTPTGDPRQQHPQQPLLVALRVQGGVLQRAFQQQVVALAQQQDALSVDAQVVRTRPIGNKGPLAQASGQSAQQMIHDSSVGPAFAGRSALPVEVILCLAQVAFVQPGLDGVRRADVVVQPAERLPEAFEDLGDRLEAGQPAAGEQRRHAPLPVRPGALRQCRSRLQLAGQFGHLFLGARLALGDPGQFLAGLLRLQLGHAGPEFGLDSQLPGLGLQLHQRQAPAGDRLVEQAFPPAIDRQQDPVDHRLRHGEVDPVAQFGAPAVVVLRRAEENLPHLFAPQRQAARQALLQPLAAEQLLQPQARQHPLQQRQLPRTDDSGLTIQTARCVTRHPTPRAGVRAHHGYPPAGEHRFSGVLLIVFLLHSLPWLPHYIARSSEPAIWADSTHAAATGLSKNVSYF

SEQ ID NO: 30318 - protein, 148 aa, Pseudomonas aeruginosa
FAERVGFRQLIQLSLEAEQKYQFYYSRPSLTTNETCTSLISIRTFRNSRQCINRCQIFLPGERPYNSENSRAEPAGPAHRRPPPPAARRSPGPPRRPPRKARCVGTMPRPPTCRPPDRTHSATATRTPGSAARQSFASFPERRHTGAA

SEQ ID NO: 30319 - protein, 306 aa, Pseudomonas aeruginosa
VAWAAPLATSRVRSETCTPSFSECDSDWPAKLPNLPPRSATLLARLAVISAALPPIFAPSLASPPTAEPPKLTTAASSATAISIPISAGPSFSITSLLINPSAAACCTDWETTPMTPPAIISAPAAAPTPVATMIAPTMIEAIALIQPKILAARPDFWASFAASSDSLIFCWLSSIFCRFCFRACSISVSLSFFCWFSTSPVIFASSISNACGDIRPADNSVEAPASTTCRASPASSPTACTRLAISARLATSRRCWLAADGGVSATPVPLAEAAAGAARRSTRRLSTYLATGLPSAGTSPASATP

SEQ ID NO: 30320 - protein, 249 aa, Pseudomonas aeruginosa
ADTRNSRRSHCAPGCRRACRTSRSTSRPCPGGAEGLAASNQASALSTCASLSGWPAWASTIRSLRNRASSSSCSALAGAADAARSSSRNSSRAALRFLTSIVIPQINKPRIGVGRRGRVPCSPCVGWELRMRRSSASSSSSAARASSRSGAWNSSSPASAASPRPCHISASRRPRSSLSRIASSAAWTVARRVSSVYSFMSSMVGIDVAGACQARSGFCRFRRLRCVTTRPASSSNQPSAGSAAPVQRR

SEQ ID NO: 30321 - protein, 245 aa, Pseudomonas aeruginosa
GPGGDRAAPGGSRRGAAGRGTPAGAGRSRTGAVAPAARDTGWRRGSPPAGRRAPADGAPAGAARTARHAPGRVVRCRCARHRPGSCGEHFAARRAQRLQGLVQRRDADLPGFQGDAQQQARFAAPGATQRQAPGRARMAQGATPAGCRDRPGARPGHRPARATTVRHGVPAARCRCPRNPVAPRAPAAPVRSPAGPGRTARRPAQPSPCCCSSSRSIARSSAIWQAFKRFWRCSSSPNTSTGNRR

SEQ ID NO: 30322 - protein, 320 aa, Pseudomonas aeruginosa
TAHPPRLSAIGVRRAATLDGACRAIRAGLDHRALHRAGGRRRHERAGGRRDPLDSRRAHRAVAQAGRRQPLSGHRRAALGEPGHEPDRRRRSAPCGRTLARMAGEVRGSRVAAEDRRIPERPGQRSRPGHREDRGDPPVAAPGYPRNQRLRTGLRAVAEPLRMSLALLLRVRRLRLDRAERAQGRQLLRVRAAAQEHTERQAAQRDYRDWRLAEEQRLFLACQAAMLDRRRLEAWQQQVGLLREKEAGLEQDCAETAQRLEGERERLRQCRRELLERQRQLEKFAELERHVDAERQGLRERSEEGELEEFTRHETWPCSS

SEQ ID NO: 30323 - protein, 770 aa, Pseudomonas aeruginosa
HGKRRRSPRASRRPRKPGSRPAFRRLRSTNRRWCRCPPTRKSQVGRMSGHSPAPASRRKPQPRSRPRRRPVSRIRRPRRQRAAKAAERSVGNPEKPIHPHCPPTTKRLCHCLPCKPPATAWWHACWHRAGAGHCRWPISRACSMPCRGASRSPAQPKAMRRACRCDCPSSAPWRCRSCMAMASCRSRSVPAPAAWRFSSKPVASCSNACNGCIRNNRCNSPSTSSRTAASARGNVATCMKSGKPNERYGPRPAARQPRRTGSPATSRALPSPLCRQRFASAPGHRPGRPRRRSRTEPGVGRPAPALSLPGSGARPLARAEPAGGSLRQPAGGPATGLAGARRQRLSRPGLVRPEPGATTRCDGPAFEPGTRRPAPGALARRRSRDAAGTPAAAPLGATPGHTAAPVAAMARPAAGRQRAAHPGARRPVAAACRSSPRRSAAGGSRRTPLGALPTPLHATGTARHARHPLPRRRRGPARTRPTADPGQLRGRPPHPGPAYPLHPAARLAARSRQCPGRRSAHPRQPALPRYRRTGQAPGSARGARNPPVRTRRSMIQLPDELGLILGLALLALVPFIAVMATSFIKMTVVFSLLRNALGVQQIPPNMAMYGLAIILSLYVMAPVGFATRDYLRNHDVSLSDSASVERFLDEGMAPYRNFLKRQIQEREHTFFMESTRQVWPSEYAERLDPDSLLILLPAFTVSELTRAFEIGFLIYLPFIAIDLIISNILLAMGMMMVSPMTISLPFKLLLFVLLDGWARLTHGLVISYGG

SEQ ID NO: 30324 - protein, 579 aa, Pseudomonas aeruginosa
ADPGRRPGAQRRGLFAGAVRLPDRRRQPAAGPRRAGHRPADRQGSAARPAHRLRRHHSLLGHGSDRLHHRQPAWRGTRLDLQPQPGQPDQPHRAVADADADHPVLLRRRLPRAGRLAVQELCQLAGEQFLPAARQPMGGILLRAILADADALRAVRRAAADRHVPRRVRPGAGQPLRPVAERVHPRHADQEPGGQPAAGALPGHPHGARLRCPAARRRPAAPAASRAGDAMSAEKTEQPTAKKLRDARRQGQVVKSKEIVSSALILSLVALLMGFSDYYLEHLGKLLLLPAEYIDLPFRQALETILENLLQELLYLLAPVLLVAALVVVLSHVGQYGFLLSLDSVKPDLKKINPVEGAKKIFSIRSLVEFLKSTLKVALLSLLVWLTLQGNLASLLRIPACGLDCVAPVSGLMLRQLMLVCAVGFLAIAVADYAFERHQHYKQLRMSKDEVKREYKEMEGSPEIKSKRRQFHQELQSSNLRADVRRSSVIVANPTHVAIGIRYRRGETPLPLVTLKHTDALALRVRRIAEEEGIPVLQRIPLARALLRDGNVDQYIPADLIQATAEVLRWLESQQTDTP

SEQ ID NO: 30325 - protein, 316 aa, Pseudomonas aeruginosa
QVEPRRRMAPAAPDRYRLPMSQPTSPLVLHLPYQSPWEWRQFHQHFALRLLAGVESLGDDHYARSFRANGRPAWFEVRPLAERQVLALSLSPSAHALAAELEARVRRMFDLDSDPAAIARHFAGDPLLGPLVAANPGLRLPVAFDPFEQAVRAIVGQQVTVKAAVTITGRLIQRLGEPLEDLGYDGISHLFPTPAALAQANLDGIGMPGKRVQTLQRFAAAIASGELSLDLADGPEALVERLCALPGIGPWTAEYIALRAMGEADAFPAADLGLLKSTVWGPQGIDARSLKARAEAWRPWRAYAAIHLWHHYAAGG

SEQ ID NO: 30326 - protein, 233 aa, Pseudomonas aeruginosa
PARSLHEDVGEAGHRRMAVQAAAFAGQAERAHARVARGVQLLHHVGKEKDFRGRQADGPGDPRIGGAFPLRPAGSVEVAGKQRAQVAGLGTAEDQLLRLDRAGGIDVQVQPTGLPLAQRLHRVRVDVALQLTVAVALGPDHALQGLQRRRLAVLGDPLQEDRDRPLDIGVRLTALGTHRRQLCGYLGLSGVFADEVRQVPGGIGKQHVENEADRAGGAFDVGEDGFDGHADSG

SEQ ID NO: 30327 - protein, 458 aa, Pseudomonas aeruginosa
SAGSAVHGCRSCPHLLQTGTDDSGCQQGCQAGDGEGPGRAQAVPAIAGIQRAQGSAGTGQRSIQGLALALLARAEATLHEMDGSRMKTAEGGGMQRLGKDQQRQAVGQVAEKQPAQRRQQEARGQHLAQAEALQQAWHGEEQHDLGDHPQRPEQTDQRPAVAQRFQVQGQEGVVRPMGQLHQAHAQVERQHARLAQLGEEAALAFARFAMGRLGIGHPPAAQHDAEHDTQQRRRVDIQAQALEQRAETDHGADETDRAPQANPAVAGAALAQVGQGDDLELRQHGVPEERVQRHHQGQPGVAVADEDQREAQRRAYRAEAHDGQALAAAVAQPAPQVGRDATHQHGNRHQLADARTGEAQVMEIQGEERRRGAEQAEIEEIEAGQAPVGNRAGHDPPFTRPASLPATALTAAAGPACRRARRRSAHAGAAIGRAGRWPSSPRRSAWRGCRRTGRDGPW

SEQ ID NO: 30328 - protein, 372 aa, Pseudomonas aeruginosa
RACRRCCRTCEAPREDDRERHRSIPVKDGPANLPRRTRSKRYHRPMKTSMPRALLALFCLLASLAHAAPNSILHRPYDLDTGHGVLRGSLLLPRSAVPPPVVLLVAGSGPTDRDGNNPFGGNNRYLLRLAEALAERGIASVRYDKRGVARSLAAAPREEDLSVGAYVDDVVAWSERLARDPRFSRLILVGHSEGALIASLAAPRTPAEELIAIAGSGQPIDRVLREQLRGRLPPAQLRQADSVLASLKAGETRGDIPPALANLLRPSVQPYLISLFREDPARAFGRLRIPTLIVQGRNDIQVGVADAEALQRAKPDSQLVLIDGMNHILRIAPSTGLQQLSAYNDPNLPLARQLVEAVSRFILRGAEAEKGR

SEQ ID NO: 30329 - protein, 154 aa, Pseudomonas aeruginosa
HASSAHPFADQRTRLPASPPSAEHLADHRCPGRVPQRRPAPARPRRRRRGDRRAGAGGPRQRYAHRACTPPGYPGRPVRSARAARPVPPGTATGSRGKSRGETPAQCLLRHRAARPAAEPRPSRPDRLRLHDPFQRQHHRARGQGLRLPLHPRR

SEQ ID NO: 30330 - protein, 269 aa, Pseudomonas aeruginosa
KFRMASAPKEEEINMIYYLIGVALFIFMLEQLVPGWKLPKVSTWVARVIFLNIVQVSIALLAGITWNKWMMGHSLLHTSDALPPLLAGFAAYFVNTFVTYWWHRARHANDTLWRLFHQLHHAPQRIEVFTSFYKHPTEMVFNSLLGSFVAYVVMGISIEAGAYYIMFAALGEMFYHSNLRTPHVLGYLFQRPEMHRIHHQRDRHECNYSDFPIWDMLFGTYENPRRIDEPQGFAGDKEQQFVDMLLFRDVHSLPGKTQPAPVLVKPDVR

SEQ ID NO: 30331 - protein, 175 aa, Pseudomonas aeruginosa
ARYARTTRTPAMPRASRATPSSESATSPAWPAPSWSAPARRWRSWPGRAKWKSATRSSAASSSTYRSTATPPPARPARVSSARSSASSSGSPGPCPARPRPALSSRCAAARTAGTGPTARSSSAWNRATTARPGWTTRPWNRSSCRACRSTRNGSPASRASRSGPASSPRPPSTH

SEQ ID NO: 30332 - protein, 261 aa, Pseudomonas aeruginosa
SCATTSAAASRTRSESSTGTARTMPGSLRRPMPPTSPTPTNPHPRLPPDHTGNPMNTQIAQITQSLAANGCAYITPSDALYDEQDWELMNQVLANSTLPWEKILIGDADEENDLYVARFMTDRDRPTVVNHALSELIIPRVCNDNVMSLFRKLMGDDAFYVRRMQVNRMKAGSFIGRHLDTDSNPDYQYSIVLQLGTYFSGGQFVVYDRDGNLRNDIKPEPRSVIISDCSYPHEVQQVTAGERVSLVFFVSRHADRNRRVY

SEQ ID NO: 30333 - protein, 741 aa, Pseudomonas aeruginosa
PAHRLGLHQYRLAHPGRLPGARRSPGPAALPDPGRLPALRDALGTHRRARRRDGLAGGPQHPPRPGDQRHLRTGAAAAGAARPAGDRPRLDRPRPSRQDLPEPAGDQPGRRLGTVPRRRRRLRRTAAEHGLCRRRGQHRLRLRRSRTAPRRRRRPPWPGPLARLGEPLRLGRLRSGKRQATQPQPPRRVHRHGEPAHRAARQCLRLRPRLGPALPLRTHPRVARRPRPAHPGRQLGVAERRVLQRDGEPVAEDAGAGQRPRTARQRGLRPAPGLEPPGRRRPGRATDRRLLGTRLHPRAAATEDRHAVAGQRLEPAQLRRIPPADPRRPGRPALLVRPGTRLRPQAEPVAAPRPRRTASRPRKRAERLEVGRGARRPRRARALPQDPVARAVRPEEQQGRRQLQRQRRALGLQRPGQPVQHTDRRDPADGHRPGGLRQLALRAVHPQFRPAVRRRHRSQRTLGPRRVHPYRRRRPRRDGPPVGPAPFSPFLRRATTMTSDPQKNAFDLDYSSRERQFPEGFKRKIVADLQEGMPQFDVLQYFGNQPDIFETYDHLVLATDPEGERIIGILGAKDFVRGSTRFLYLWTAMVVDRYHRTSLFKRINQFFLRQVSERNGGLPPLIVAKTYNPVVYNMFRALSARIPGATLYPDLEAPRQNPDMVDLALDVVGTLSANLRLDAETGLIPGGQRSVAPDFFPRMAMSSHARTNDHFVAHVGSSDQILCMVRLAPGAEPYVQQRIIR

SEQ ID NO: 30334 - protein, 284 aa, Pseudomonas aeruginosa
PRRWPRCTGSRARRIHWRAWRHRSSSAGSTSPSGRATARAAGKPAAPSRRPRSSRSPSAGSARILGAFLSAQGRAIAMLEILGKASSINVRKVLWTCAELDLPYRREDWGSGFRDTHAAEFLALNPNAMVPVLRDGELVLWESNSIIRYLANRYAGERLYPQQAAPRARVDQWLDWQASDLNRSWSYAFMSLVRQSPAHRDAAQVEASLRGWTGFMEILEGQLLRTGAYVAGETFSLADIAIGLSVNRWYETPFEHPSLPAVRAYYERLGARPGFLAHGRNGVP

SEQ ID NO: 30335 - protein, 291 aa, Pseudomonas aeruginosa
SPSWPPPSARPSTNVRLAPPTTGSATTRCGRTSRSASASTSTTSKPRPCTGGCNGNSRNPAPAANRTSSMKTLSSLLLIGFAVVLLAPRMAPAASAAEDKATYCGSGFTQYLVPDDVAGCSLSEACRLHDICYGRCDKDGDLYGSAYCAQSEKSEARNMSKQQCDARLQADIAAQNGNSRLCRAVGGVYRVFVKHLGQGPFNGREALDIYLKVMQSAPSAADADARLEAIHQLQKQGLTDAKEIRYDAERIVIPLNRPVESPLTNGSDTLVLPRNLDRERLRQLDQRLIRQ

SEQ ID NO: 30336 - protein, 782 aa, Pseudomonas aeruginosa
CHLPVDQSGEIVADERQDGVGHRLQLLAHVVLVVDGRTPRLERLGTGDADHVADPAAALVLPRAPALEVVVVGDARRAHMRRHVALVIVEAPAQALAVDQQVVQLAGQGPSYVIAHVVLVGLAIEDAQVEFLLEALGQRRPVGAHGLQALEDHLLATVGAAHQAGVAFLAALLGAAHGGHEKTPVMGLELQLEGAVEAEFFFQVLAPPVVDPRHQRPADGRGLLLGAGAAEPDEGGVGIAIDHRIALGLDQLAGTAHDPMPAQGDGRGQARVEEAAAAGTQHPVEGVHDDLQRLRERLVAFALGRLAALPDPCDDGRQAMPGTREAGAAKAFHRVLVVRLAQAFHQADRIDQEGTDDRRIQALVVKHQHRFVEARPRVHDEAAGTGFRTLLAEVRGDEAGAVHQRHVQVGEGRHRAAAAVRRQAGDGGPFEEEVEQFGTGEDPRHQFAVLQVVVREGRLVLGEHAIDLVHPLVRIVDRLAFAEQGPGDVLQAERGEAPGRRAQRLDAIDDQAAGRRGEKVVVAAAVLAPAHFVAATPQAQRHLQALGMLMQDAQVELHQVPADDGVGIVLGQPLVETFQQPGTAVAIVEAEIHGRGIAVGRAEHVYLALAAAFQGDGVEIAAGVGLDVQRHQAQARAIVRSRLQAPGEQAAVSLDTRLQADRRGDEALHQVALRRPDIGLEHLDAGLAQAFLQIHQLAMLLAVQAEHRPLLEVAQRQRPQLGASLPGEQGLDAPALLGEDERHRRLRRQPHLPRALLGRQPERDFRAGRRIAPVPGQDEPLQ

SEQ ID NO: 30337 - protein, 365 aa, Pseudomonas aeruginosa
SGISPTRVQPVFRYSRSAALPLTVSSTSRDLPQARASRSSSPISASPMPRRRARRCTSIFATSARCDWFGGWSRSSCTVPTIRPSASATSSRRSSPATLSPTPRQKASARSRGNGHMKLTEAPPSTQSSSTSASSSRRARISSPARRRIVGSVIAGKLQCKGEFPIYWTVTIMDEKNPPGPLMDIDELIARRLAALRKERELTLAQLAERCAVSKAMISRIERNQSSPTASVLGRLAGGLGVALSELLGDAQAPAEPLCRRAQQEVWEDPASGYRRRQVGARDPRSGCEMVEVEIPANARLDYPRWGGRPYRQRLWLVEGALRVDYGEQSFHLQRGDRLDFGVDRAVTFATAGQACRYLLVILHD

SEQ ID NO: 30338 - protein, 127 aa, Pseudomonas aeruginosa
SPSTWRWARAPIPVSPPSSPRNSTRTGARSAWKARPPTPSATPTWPSAPCRAPAAVRRWPTPGCNCARPGPRRARCWSRPPPASGECRPPNCAPATASSNIRPASARPATVRWPLRRRNCRCRKKCN

SEQ ID NO: 30339 - protein, 124 aa, Pseudomonas aeruginosa
RTARSSRTTSTATRCCGSPRCPRSKCTSCPPAKRPPGSANPVWRPSARRWPMRSSPPPGNACTTCPSPPPSPRPERDARRQLHGCRRGAGGPPRIAADHTGLPGVAPICLRPASGADFSVHSPA

SEQ ID NO: 30340 - protein, 186 aa, Pseudomonas aeruginosa
PSMTEPLPSSSLGPALRRWRLLHRVKQTHAAELLGVAQSTISRWESGTQALLVEERARLERLLGARLEAAADQALARLVEANPQPVHLICDLTHRLLACSPARAAQFGVPLGELLDRSLWPYCSEEILRQEATLEELGWRELLAPPALEFASGANASAIVPIRRSRCRWTRMTLSDGRAVRLVETL

SEQ ID NO: 30341 - protein, 221 aa, Pseudomonas aeruginosa
RRHGYFIHGPSAPPRLGLQARFTGSGGRAMSLELLSNRLEFLREAERLKDVLRSAHTSSGRPESTAEHSWRLCLMALAFEDQLAGLDLGKVLRMCVVHDLGEAIHGDIPAVEQAAHPDKGEQERADLLQLTRHLDTPLRDRLLALWDEYERGESAEALAVKALDKLETLLQHTQGDNPADFDYAFNLDYGRRYTDRAPLFKTLRELLDARTRQRLAARRDA

SEQ ID NO: 30342 - protein, 663 aa, Pseudomonas aeruginosa
QHPGQPDGLALAAGQAGVALDRHVQPQRVAADEGAQADPVEGLQQFLVAQRGVLQVEVVAQAAMEQRHVLRQVADTALAVGRVDLGQADVVQQQASRLRVEQAAEQAQQGRLAGAVAAEQRHPLAGADVQGLHVDHRRAVAVGHAHALQAVMSLQALLVHEALALGSLLLGAHQLVEAFHRHLGVLPATEDAGRLRQRCDGPRGEDRAGHQAADGHRALADPIDAEDHHADVAELLDDARRVAQGRGQGMGLHRRTGQFAGQGFPLVQAAAFGAGRLDRLQVLEGFQQHAVLHRPFAQVLPRQVAEQALGQQPRQDHQHAGHQRHPDHMAADHGDDQQEDRHERQVADQRRAGRGKELAHRLELPHLGTEGAHRRRLGGDPGAQHAGEQQGRELQVEALAEHVEQVAAHDPQDTVEDDRQGHAAGEDPQGVERRVGHHAVVDLHGEQCRGDRQDVGHQRRGGDLGVGTPEPLERAEEPVFGQGAGVVADPPVRPVAALGEDRRAAVQRFQLGQRHPLASAVALRYQHLGVLAVVAHQHQGAAVVEQQQGRQQVAIDPAQRLAGDLGGDVGAAQRAGHQVQRQATVLQRHAVHQFGVAERSAKLPAEQQQALAQRVDDGVVVEDHDVIRGFLSFHDSAGSPIADPTGRLARPPDTRCACVRSAG

SEQ ID NO: 30343 - protein, 286 aa, Pseudomonas aeruginosa
AGRSRRAGQPRTVRDTTRRPAPTRSPAGSATVPASAACRRCRRGSAVAGGCRAASRRRSISPTPGAAARRSAGGSWKAPGRCPCGSAGIPPSRFPDARRSPGAARWPPGSVAAAATPWPRGPRPRRHWRPPGPCAAKAIRGSPAPYRWPPGSVAATSARAPPGRRAPGRPGSRTGCARPAGCPSPATTAPGPATVPDWRDPARCGRRSRRRRAPGSSRGCRRGAGCVSAPPPPGAPRQARRGRSRRYPAPHRRAPPAPPRTACAGSRWRCRPCSSPDPSRTASATR

SEQ ID NO: 30344 - protein, 1376 aa, Pseudomonas aeruginosa
PPGRGAWPTRTSADPGKGARWLPSHAAVPCARTACARASDHDLYRVVLDQQGGTAEGVDVVGNAVDQLRGTGIHRAHHVQGVVVLAGDLQRVVGIGDGIHLRRGQGQHATRVALAEVDALEVAERADADGVVVEVDAVGQDQGVEPGAAIDADEIGRGDLDGVVAVAGHHVIAGAHVEDQVAAVAAVDVLRTAVGAGQHVVAGSTVDIDLADIERQSVGGQGDPVGGAVVAIGVGGHQVERDLRAEVEDVGDVQPQLGEDGRAQQVQREVSGRIRLDRQQFDVQRRGDDPDHHAGVRLGGSAETETRVQRVEADVEAEVADGHRLLDAGADADARRVARVAGRVASDHRHLGIEQLVPTEVDVQVGEQVQRRQPAVVGGHRGGGGHPADVDGDRQLGPWLRRDSQDVADQGQHRGRRRNGVDGERHRGRRGAAVDVGGDGRGALRERAHAAGRRQGQGQVAGGDVAGGEGMADLGLVAVLPGELDRDHLADLHGRTDRHIDLDAVPDLRGVDPGIGGFRHADGRRRQVRRVDGGRPADVAGGVHGNPGDQFAGDQRRRERQAEVAGAVDGDRDRVGGVAVDHDTHLTVRLGGAGQQRAVGADAQQRSGRRHRVHRGAGRTAGVARGVFGDGVDHRTVGQRRAGGEGPVATAVGGGLADRVAVAVGEDHFGADLGGAGDHAAVAGIDHRRGRRHRIHRGAGRTAGIAGRVLGHGVDHRAVGQRRARCEGPVAATVGEGLADRVAIAIGEDHPDAGFGGAAEFDTIARVDHRGGRGHRVHCGADRTAGVAGGVLGHRIDHRAVGQRCARSEAPVAAAIGGGLPYRVAAAVGEDHRGPGFGGTADHRTVARIEHRGGRGYRVHRGAGRAAGVAGGVLGQRIDHRAVGQRRAGREAPVAAAVGGDLADRVAAAVGEDHRGAGFRGTGDHAAVARVDHRGGRGHRVHRGAGRAAGIAGRILGHRIDHRAVGQRRARGEAPVAAAIGGGLADRVAAAIGEDHRRTGFRGTGDHAAVARVDHRRGRRHRVHRGAGRAAGVAGSVLGHRIDHRAIGQRRAGREAPVAAAIGGDLADRVAVAVGEDHRGTSLGGTGDHATVARIDHRGCWRQRVDGGAGGTAVVAGGVLGQRIDHRAIGQRRGGRESPLAAAVGGDLADRVAVAVGEDHRGPGFRRTADDDSVARIDHRRRRGDGIDGDAGRTAGIAGRVLGHGVDHGAVGQRGARGERPVAAAVGGGLADRVAAAIGEDHRRAGLRGTAYLGAVARIDHRRRRGHAIHSDHRRRTVDIAWAARHHVDHRAIRQRDAWSEGPVTAAVGGDLANRVAVAIGDDDGVAGVRGAADHRTVARIHLRDRRQRGIHRRGSGSAGIAGGVARGHVDHGAVG

SEQ ID NO: 30345 - protein, 1395 aa, Pseudomonas aeruginosa
LRAGREAPVAAAIGGGLADRVAVAVGQGHGAARLGGTVEQVAVARIDHRRVRRHRVHGSAALRAGIARRVLGHGVDHRAVGQRRGGREGPVAAAVGGGFADRVAVAVGEDHLGPGLRGAADGRAVARIDHRRRRRHRVHRGGGLRAGIAGRVGGRGDDHRAVGRRRARREAPVAAAVGGDLPYRVAAGIGEGHGGTGLGGAADDDAVARVDHRRRRRAGIDGHRRRRAAVTGGVLGHHVDHSTVGDRRGRGVGPVAAAVGGDLGDRIAVAVGEDHRAARFRSAAEAAAIAQVDGRRGRRDGVHGSAALAAGIAGRVGSGGVDHGSIRQRRGRGEAPVAAAVGGDLPDRIAAAIGQGHGGARFGGAADDDSVARIDHRRGRRHRVHGGAGRSAGIAGRVAGRGVDHGAVGQRRARCEAPVATAVGGDLANRVAVAVGQAHGSARLGGAAERGAVARVDHRSRRGLRVHGDAGARAAIAGGVLGHHVDHGAVGDRRGRGVGPVAAAVGGDLGDRIAVAVGEDHRAARFRSAAEAAAVAQVDGRRGRRHAIDGGAALAAGVARRIGGRGVDHGSIRQRRGRGEAPVAAAVGGDLADRVAVAIGQGHAAARLGGAAERGAVAGVDHWRGRGYRVHGDTAARTGVAGGVGGRGVDHGAVGQRRGRSEAPVAAAIGGDLPDGIAVAIGQGHGGARLGGAAERGAVARVDHWRGRCHGVHGDAGRRTGVAGRVGSRGVDHRAVGQRRARGEGPVAAAVGGDLANRVAVAVGQGHGSARLGGAAEGRTVARIDGGRGRRDGIHGNAGRRTAVAGGIPGHHVDHGTVRQRGGRRERPVAVGIGGGLADRIAIAVGQGHAAARFGSPAEFAAVARLDHRRVRRHAVDGDGGRRAAVAGGVPGHHIDHGAIRQLATGGEAPVAVGIGAGLADRIAVAVGDHDGHARFRRTAEDAAVAGIDLGRVGEVGSFGGDRGAAVAGRVGNDHRHRLAIGQRRVQRDLEPAAGADHHGGVRLAVAIGVDTDGGARLCVAGDAAAVRRHLHVGGRRRGCGVRRLDGHRGAVVAGRVGNDHRHRLAIGQRRVQRNLEAAAGADHHGGVRLAVAVGIDAHRRAGFGLAGDAAAVRRHLHVGSRRRGGSVRSGDLGRRAGVASRVSDHHGDRLAIGQRRVQRSGEIAVGIGDHGEVRLAVAIGIDADARAGLGLAADAAAVRRYLQAAGRLRRSGVRGHRRTAAATAAAAVGNRHPGADGRRTDQQRSPCAHATEHTGAGQRLETGQAFLRDVAGHQRPVGSDRRQIYRHQLVLVGQEQLAGRLAFRIEVGDPDAFPGLQLDDQVRTALRVSRHRLRCDIERDITALGEFEYPVFRNLDGSRRRNTLIDRGNFRLDRHFRHSSCQAATERPHHVIQK

SEQ ID NO: 30346 - protein, 167 aa, Pseudomonas aeruginosa
SVRQRTPTEPNRSQNARRRKYFDTVCALSVPRRRNRRADHDAPARPRRGRGRLRSRCHARPSGACPRAIRRRARPASGRRFRRSGFPAPDRPCRRYPGNHRPRPAARQRGPPRVPAARKIRPPPRPRAARRRSAPYAPGGARRNRARASNPCGPGYHRFPGVLFSVV

SEQ ID NO: 30347 - protein, 821 aa, Pseudomonas aeruginosa
RRLRRVRALANLQHLAAATVAQGRRVRQARLLHQHRGWSRIAARRANRCRCDLGGGTQVDGAGILEQRARRFAGGTAQQLDGTVTAMADALQAGGIADDARAQEDHQVALHPGLAGRAEQPADAGDVAQQRYPRIAALQVVLDQSTEDDDLAVVSQYGALDRALVGHQVHRLRRQGGGWRDGGYFLLDLQAQHAVLADVRRDLEGHPDILALDSGERIARTAGAGGVAAGLERHVLADQDFRLLVVQGQQARRRQQVAAAIAAQRGDQCAEIATAEADYRTVGQLCRRLAGLQRAQQGADGQPAVGEASAAGDMPATQRPLHPEGVADLAGQLDDRRLHQQLRARHVELADDVLEQADILRVGEDHQGIQRFVGAHQQAALAASPAILAPLAVQRFADLPEGGGKGLGVAMAHADHPAVRRPRRGDVERLRQPQQARSRLRRTEQDQAVAAAVGKDLDGGGALPGGRGDAAIEHLGDFRDPGMAHVVDAVVMFAGPVEDAHDRLDALDVGAAVADDQRVGRRYGGQMAMGRDQRPDHRDQFRHRGLMRLDHPRLQAARPIADGLLRGVLACLHVRHDTRVVALRQHRVAMGGEHRKEQLVDLRQAEPRLGYHRDPPLHPRIDDEGLAADARYLLDEVADLGILHVDRPLLFLLRGGSLGRCRMDRRRQAEDGQRQDQEQRRQALGGTGTTTWHGWFLPLRLWGNTDVLHNPGRAAPHGRDEPPAARCRGALRRPAGSAASARPPRSAPPSGPRDAPGSRPAGAIADARPPSRRAATERHRTSRLTPRAGPLKGWLAAPGPLRRAIPPARGAASASGWPGWR

SEQ ID NO: 30348 - protein, 136 aa, Pseudomonas aeruginosa
PGPGHGAWRRDRSSSCSRPPPGRTSAPVPGPGSRDRPGAPAPPRATAPGPASAPPRRRRGPPAGVRRSPGPGDRTRRGRPCPGARRPCPAPPVPAPAPAVRRSPLPGYAGHAARGPGPGSWRPGRTAGPGAARASP

SEQ ID NO: 30349 - protein, 280 aa, Pseudomonas aeruginosa
KGSGSAGEFTGSGAWYCSCIQIPAPPRLGNAHPIKRRRPDDDYPGTRRSLYKNINNETCPVSVPMKKIRQRNLQLILDAACEVFADCGFSAARLSDVAERAGVAKANVLYYYRSKAQLYEAVLDSIVEPLLEASRPFAGDQPPAEALRAYVDNKMRIGAERPHAARVFSCEIMRGAPRMPAPLLERLDAQAERNAERIRQWIDEGLLAPLDPYHLLLNLWAMTESYALGGWQLARLTGQAGLDASDYRQAAENIVRLVCAGCLALPGEAAPRRRFRALAG

SEQ ID NO: 30350 - protein, 268 aa, Pseudomonas aeruginosa
ACASPVRQLRSPPQEHSMTTRLPQLLLALLASAVSLAASADEVQVAVAANFTAPIQAIAKEFEKDTGHRLVAAYGATGQFYTQIKNGAPFQVFLSADDSTPAKLEQEGEIVPGSRFTYAIGTLALWSPKAGYVDAKGEVLKSGSFRHLSIANPKTAPYGLAATQAMDKLGLAATLGPKLVEGQNISQAYQFVSSGNAELGFVALSQIYKDGKVATGSAWIVPAELHDPIRQDAVILNKGKDNAAAKALVDYLKGAKAAALIKSYGYEL

SEQ ID NO: 30351 - protein, 232 aa, Pseudomonas aeruginosa
GGTCMALPLDSTDLAAIWLTIELASLTTLLLLLIGTPIAWWLARTRSWLKGPIGAVVALPLVLPPTVIGFYLLVSMGPNGFIGQLTQSLGLGTLPFTFAGLVVGSVFYSLPFVVQPLQNAFEAIGEKPLEAAATLRASPVDRFFSVVLPLARPGFVTAAILGFAHTVGEFGVVLMIGGNIPEKTRVVSVQIFDHVEAMEYAQAHCLAGGMVAFSFVVLLALYSGRRRRPGWA

SEQ ID NO: 30352 - protein, 412 aa, Pseudomonas aeruginosa
DGRPAPALPPRLPRLRTGHRPGSSRSWRDRSVRPFRLRQEHLPALYRRPGKGRRGRGDDQRRDLAGQPPQPLRRAPPACPRLRVPGCQPVPPPDGAAQPGLRSQAHRRRRTPRRAGTGLRPAGHRAPAGTHAGTPLRRRAATRRHRPGPPHQPAPAADGRASGIPRPEAQGRDPALSRAPARGTGHPGALCQPLARRSGAPGRSPGAAGERQGPRQRADRRNPGASRPAAGAGRRCRGGDRGHGQRPRPGLRPADPGPARQRAANARRPRPAGPRQAPALQGTGARRQPEPARRRPEQHPQPPAGTGPGIGRYRHRGPRPGAPGCRRQSAAGADHPLLAGPVATTTRPAVVGADQVGGGARLTPASPAAPRPWANGSGSAAPSAAGRRSRCRSAASAATTAAAWQRPAGHSR

SEQ ID NO: 30353 - protein, 659 aa, Pseudomonas aeruginosa
ANTGNRSTPSTIATRNWRCASSASSTSSSSAWAPETDRERIPRFLALPRALGVATRRRALRHPQQPPAAGAPSRRSGDAEDIQCRRRAFRPRTAQLVGRPGRGQGAGLRPPGAADGACHRRALAAGDGQARRRRRGYAYPLPGHRTHPCPAPGSVARADPAGALVRLAVCRRAPLRRALRRLRECRPLPAGDRSRTAPAAWRHPPRQCARLRRARLASHRPQAALRRARLRLRQPVHQSRREDRPGARPFRAPAGDRNRRQRPAAPPPAAMDPGLDRTLGGLVRRGRQPRGDRSRAGHRPPGPGKPRSNACANELCGGSRAPTRGTVPPPRSGVKYTPRQDGGAHHPVRKPKMAGASLLTLLDDIAAVLDDVSLMTKVAAKKTAGVLGDDLALNAQQVTGVNADRELPVVWAVAKGSLRNKAILVPAALLISAFAPWAVIPLLMLGGAYLCFEGFEKIAHKYLPHDDEHADEAALAANVDVAALEKQKIGGAIRTDFILSAEIIAITLGTVAESSFTTQVLVLVGIALVMTIGVYGLVAGIVKLDDAGLYLSKRDSGFAQGLGGAILRTAPYLMKGLSVVGMAAMFMVGGGILTHGIPVVHHAIEQAAQSVAGIATLGPMLAAITPTLLNFLFGIVAGAVVLAVVLLVKRLLPKKKKTG

SEQ ID NO: 30354 - protein, 474 aa, Pseudomonas aeruginosa
QKRSGRLQLRRRPPVHLDDPGLGHPRHGPGGVHRRPTGLAGAQPRPALDQLRPHPPDPHQPGDLRLRRQRVVRHLLLRGAAHQRRAADLRCPGALRVLGLAGGDRGDDRQLPVGYTTSKEYAEMEWPLALWLAILWVVYAYLFFGTFTVRKVKHINVGNCFYGAFIIVTAMVHMVNHALLPVSLGKSYSAYSGATDAMIQWWYGHSVVGFILSVGFLGMMYYLVPKQAGRPIYSYRLSIVHFWAIISIYIWAGPHHLHYTALPDWAQSLGMVMSLILLAPSWGGMINGMMTLSGAWHKLRDDPILRFLVVSLAFYGMSTFEGPMMAIKTVNSLSHYTDWTIGHVHAGALGWVAMISIGTLYHMIPKLWGRERMHSVGLINAHFWLATIGTVLYIASMWVNGITQGLMWRAVNEDGTLTYSFVEALVASHPGYVVRLLGGATFASGMLLMAYNTWRTLRSAQDQRQPVLAAGQGA

SEQ ID NO: 30355 - protein, 490 aa, Pseudomonas aeruginosa
TCCCPCCASPPWRSASPSGSPAVPARNANRPPCCHSPTIPRPPAGSPGIPARSAGRWSAPSRNPARPPARRSSPEPTPSSRDGCLQHESALRGRQRPLSFASKSSMNDSPSTAVRTWLKGFRPLTLNARPRDCLRAGLGACIGALAAVFACQALFGSELALRLAAPLGASAVLLFALASSPLAQPWSMLGGNLVAALVGGLSAYWFGHDLAPALVGMALGMLLMFALRCLHPPSCALALSVALNPSLSELGIDVVWPILLSTLVLIGCALLYNNLMRSPYPRPYQSPRANLHGTRDLAPSARTDFSARDLDQALQDFGEYVDITRDDLERLIHHTERYALRRRMGELTAARIMSRDVQTASTETFIDDAWKQLQEHRLKALPVLDEHRRLAGIVTQSDLLKHFRPDGSPFKRLRFLRGTKLKTIMTTPVVCVQADTHAVELVSLLSDEGLHCLPVLNEAGYLVGIVSQTDLIAALYRNWLQHLGQADQIT

SEQ ID NO: 30356 - protein, 109 aa, Pseudomonas aeruginosa
PRKCSPSAVRRAPARLRTNSRQPSCPSRFWMRAVTAVWVRCRRSAAATKLPLRAISRKVRARSISMRSGPLPQVGRHSRLCRRGQRAQGGLAALLEFCDKTPRLAASAR

SEQ ID NO: 30357 - protein, 89 aa, Pseudomonas aeruginosa
PDAPTEDLPMLELRPNCECCDRDLPGDSGDALICTFECTFCRDCATVRLGGQCPNCGGELLARPRRPRDALARHPASSRRVVRPGGCPE

SEQ ID NO: 30358 - protein, 412 aa, Pseudomonas aeruginosa
RHAATQPDPAPAVLRPGPVLVLLADRHNPDRPGRRPAGAVEQPGNPAPGPAGAGQPAGGAAVVALHAAPRPTSRADARRRRRRARRPGLRRRCLDWRFPLVLSRRAGHRGLPGLGHVLPVRRAGGGGCRAERPRQRLRARRRSTRRAAGAEPGAVVAQRAGPALRRRLSADRRAGPRRPAADGSAPRRPGATPGTTRLARHRRPVAAAGGPRGHRLHRGRTRVDDPDHERHAAGHELLRPAAGTVESGHPVARAGNVPSGVLRRTAGRPHRQPSRRPARRVPARRKCRHRPGRAVGHAFPAQFAGPGQRLEPDAHRRHHPARRGPRRKRARRRARIDGARQQPGGGADVVRLRRPDHQPWLERGEPAGLAGAAGGADTALAGTTNADAVALKRRQRKRRPCGRLFCLTETPQ

SEQ ID NO: 30359 - protein, 197 aa, Pseudomonas aeruginosa
GRRSDAAVLRRRPSSAASPAIPARSACHRRRPGSPSTSSACRCSGTSRRATAGARRPASGGGSSARRRCGSGRSTAASAPGARRCRRHRSSPPARSRFARTAGSPSATGSAVPRQAGPCAPRRCRTGGRCSAGRCRCRARACSRSAAARRRRRPGAGLRTRCACPGRRSTGRAGSSARRSAPARPAAARSARGSWRR

SEQ ID NO: 30360 - protein, 219 aa, Pseudomonas aeruginosa
VIHGQSRSMHRQRLQEQLGQELPGRHPEQGQLFRLRPVGGRRAGRTDAPRQRQRHGRRPGAELDQARLRRRGRAEGGPGLPGDRRPEGPHLRARRGGHQRSAVSAEVPDVLVRQHRRRGRPEPGPEVGRPGVESHRPRPPQLLRLLPGQLQPAQGQLIQAVLRMSQTHSQHDSPRASRLHSPVPSPPACALRPPHSARILRQNGARDFSGPRMNILQLE

SEQ ID NO: 30361 - protein, 87 aa, Pseudomonas aeruginosa
TLRAGMEKGGPPMGIETEEPNQKPPTFWQMLHSVMAAAFGVQSGRNRARDFTHGKPVHFIMLGLLFTLVFVLLLAGIVKLVLSLSGL

SEQ ID NO: 30362 - protein, 138 aa, Pseudomonas aeruginosa
PVRSSARCACRTVSISSAMPRCCASPFPMACSPRANCASWRRSPATTTRATPTSAPGRTCSSTGRSWKTCRKSSPSWPPCRCTRFRPAATASATPPPTSSPASPATSWWTRAPGARSSANGRPSTPSSPTCRASSRSR

SEQ ID NO: 30363 - protein, 199 aa, Pseudomonas aeruginosa
STRSSRSTWNAGPRKNPSSTPSAVSVSTRSRSAYMQRIIKDRQVVDDRWHLLPKDATLESVPNSDDVIIPLALWLEHGPALRGRDGGLGVWLDADEEPESIAGDLDRFQVIAVNFPAFTDGRGFSSARLLRERYGYKGEIRAIGDVLRDQLFFMRRCGFDAYAIRADRSPEDALASLDDFSEVYQTSVEQPLPLFRRRG

SEQ ID NO: 30364 - protein, 169 aa, Pseudomonas aeruginosa
NKFLTFVYCPGAHTSSILKRPEFSMSQMMQMYQQVGPAQFSAMIGQFAPYFASIAPQFVELRPGYAEVTFPKRREVLNHIGTVHAIALCNAAELAAGTMTDASIPAGHRWIPRGMTVEYLAKATGDVRAVADGSQIDWQATGNLVVPVVAYVDDKPVFRAEITMYVSQA

SEQ ID NO: 30365 - protein, 157 aa, Pseudomonas aeruginosa
RPQPRLTSTRPTSLPARIWLIAPGSSSRAISRATSSRLSSFHCSDSLSHMDALTTSGSSTESTPSRLTPRRMNGSTEALKPAPAVRPQQATLPPYCNDLTTLKRMSPPTVSTAPAHCSLSNGLSTPSATVARSRICLAPRRLRNSACSSLPVAAATV

SEQ ID NO: 30366 - protein, 421 aa, Pseudomonas aeruginosa
TPWGASVTHNALNTAISTSSRENPEDSVFVPVGAGLLPELLLVEPPPPGHQHAVDNHAGGQADAFLQALALDELHLVDIALPGLLGQVLVAGLEFVHQQLAQCGLAQPDLAGGDLVHVQLRPVVGHEVLEQFVGHLQVLLELFPALLGVLAEYRQRTLVFAGGKHLEVNIVLLQQPVDVGQLRHHADRAEDGEGRGKDPIADAGHHVAAAGRHLVDAHGQRHAGLADARQLRGRQAVAMDHATAAFQAQHHLVVLARHAQHRSHFVAQLLGSRGLDVAVEIEHVDPRLLFRMFLRLLRRLALLLAQGLEAGLVEDAVADPLAQVLVEIVELLHVEVPACAAPAAAAQGDDHHQHHDDRRQHGHGPGQKARIFGNELHTTPSLLLTHPSTGDTIAQAYPGHRRAASDATAWRAFAGRARSSR

SEQ ID NO: 30367 - protein, 472 aa, Pseudomonas aeruginosa
AESRRTTDPQPVQELHRQVRRTAQRRLRRLRTGRPGPPGRLRAAPDRRLDRPLREGPDPRRAALGTGQGLAQGQAAGRSPQAGHRAQRLPLRQRDPRPGKPDADHRRAGLGTGHPRRSADGPRQYPRLLGGSRRPGSGAADPPPAQPPAGHADPPRVRRLLRRAGRDPTDRQPGLLLHLWPVPSCRHRPADLLPLLPRADPGQAFRPVRADEQAAGADEPAGHRALPPVTDHYKGIAHVQDPPVRPRRQDRLRFRRQPRHRRGDSQAAGPARRPRDRLEPQDRWLPGGRRRDHRGGRQGHRDRLPHRRDGADPERLRTDPRAVRPPRHPGQQRRHQPAVLQRTGNRPRRLPEDRRRQHPRLLLHVHRGRQADEGTRRRQHHQRGLDQWRIARRVPGHLLGDQGRRDQHDQGLRQGMRAVRHPLQRPPARVDRHQVRFGAGEERRDPQPRPAAHPAQARGRAERNGRRRALPG

SEQ ID NO: 30368 - protein, 452 aa, Pseudomonas aeruginosa
QPYPPPDAGRPRVPRRSPAHPGPGRTHPGGRAQRRQRTQNVAPGVRRQHHQYSATAHTPGVPPPAWRAGLPAPGRHHRGATGGVARRPHRCRPDRSAGRLPARPVHTSTGGRRHARGIARRASAGTPCAPAPGTTGRRTLAAVSTALWAGHARPDRRRLRGSRLRPGGGAGGAADADHRRAGGRRHRRRASAFAATTVAPAGGHLSSPARAAGANSLSAGAGLPHAVGTHRTLSRNRPGDRRRPGFSHGLAPVPERLLGRQVHRLGKQPGDAVVHREHRLVRHRQESHPPRQRLEQEQVVLAGPQPAPEIDPQRTLRQAQAAAPGLLLEGQEAAAERVEAIARRQTDQRGQPLPAENPRVQLPEFAVQHHAALVGALLDQHPVALRPFGLEAQGGHRLLGLEQRIAAQVPGEHQQQRRHGDEGQAAGAAQPAEEPGAFEEDAHRDQGGQQGQ

SEQ ID NO: 30369 - protein, 486 aa, Pseudomonas aeruginosa
RECPGQTVVLHASDSFCVKLRALCAPLLPTASEAVSRLEAGPVFHALRTRDRPQHPDHPGRGGLSRRLHRRHRRRRRPVDHPCAAHRRGPAAPGAGYQQAELDLRCGDRQLHLLPAQAVPSREVAQRFARHRDRRRHRRLGGSPAARRVAEPDAPGGGIHLRPLHALRRHAEGAAGRRCAARTQAPVAAGPRPGLLRRRGGTGHRSVLDRQLAAHVPAGPGPRQRCGAEHELRQQHSGAGGVRRLRPGDLVARPVHGCVADGRRLFRRAHRHRRRGEVHSPGVHPGGPGADRAASLAALVQRRLSGAPGTGRSGAGRSSAAPVAAARHRGRTTGRPRSRPPAGRSRRTRTRRGNRASANAGTASSGCRCIRDWRPPPRPLRAPRGPRTAPPTRRPRRSRPGYCIPPARSAANAPATPRRPGSPGRSCSATGAGTGAARTADTASPARGPASACVCRNCRRTGCDVPRCRSGWHSRACRTDRNRRAA

SEQ ID NO: 30370 - protein, 697 aa, Pseudomonas aeruginosa
LGLQGGAGRVQADHAEGLAQLAQLRMQVGQAIRLGHAALDQVEHVLDPGEFLADRRGQRTHHRLAGAGQALRFLFQQVVGERQRRQPMQFADLARTRALAVGQRHQVKQFLEQMARRLVGRADQQLLELAVDAREQLLARLARQQLAIDDRLDRRGADPAQPRTGHPAVQAVEARQRAAHQLEAGIEVLFADQAEQADLVHVAHPPAFLAQFGFGRQVVDGSARRPRDIQAGAEEEAFRQRRLPCGTAHFVDRRQEQLGDLLAIGLDVLQVAAQHVQGVAQGCQLAVALLADAGGNVGRQLQGFLGQQLGAGQLDQVEGAADLLQAFDGVLQQAAVLPLGNELLKTLFGLFHGGEQLVAHQTEGRGSCDHRPSAPPAQEYTTASISEFRLLLGHMRGHRHPQVGGLEHGGVPGSDVLEAVVDPVVAHIADHFLGTTDGDRRLRGDLPRQFEDPIHQCGLVRVGTIDQADAPCLFAVDHAPGVGQLAHHAIADDPRQALQGADVGGHADVDLLDRELRVGGRVAHVAGRDQVDGAAQAVALDRREHRLAAVVDRVERGLQLENLATQGVGVAADVLAQLAADLGQQHQVDPRGKMLARPGQHDHPHFVGIVDPAEDLDDLAPEVLVHGIDLVRTVDLDVGDLVCQLHTECVVLGHGDSPRQSNCAVRTQRFLLCGKSRNYNKGEPNVDAALCDARHAH

SEQ ID NO: 30371 - protein, 573 aa, Pseudomonas aeruginosa
YRNLFDDCAKRLIQRKSCWHFQSFPCRGVHREQSPEPGFRTELPRAFAALVQADGARLPLAQPPAAMAGRAGDKRLGAGRRVHLHPGHGAEMLSATAGWPVGAGGAAAWPGYPRGALCGIAAQLPGAPAADVHGRRHLLHEGPAAPAVFPPAARRALEDPAIAPVLPAGRPPLGLPRRPHRDRRGDQRGGGILRRVSPGRFGAARQRGLRSRHRPPGPRAAPGPSRGIPRLPPQPAHARGGRHRAGRRLHPGGRAAEPADRPRGRLAFRRVLPPGRAGIHAGTGGRPADLRAAGEEPPLRLWRPVAGGGAPGARRVRRQRKPQTRSAAEGRAAGAGPGGAGTDRRAGPACRRGRPDRPVGDRADHCLHRRHRRTPDRPRLPGGPAVHCAAGGVLRGGRGDPPAAPVHPDHPGGAGAADGTPAGHAVHRQRPALGDQRQRIRRHHLHHRGETGAGCRPHEPRAFRYPGGGDQYRHQPAQRSDAQRPGGVPLPADLLHRPAGAPVVRPHGLDGATLHPGDGRPGLVGGQSLALSVGTPLTWLRHCRQVYIGIPAISTRKPQKIACWPVPYSAHSE

SEQ ID NO: 30372 - protein, 197 aa, Pseudomonas aeruginosa
SRRRYGRRRNCARHGPRPRPGGRYGRAAIPARGPRPTGRNAACSPRRTGGTPVPPDSCDRRHRRRGPAYARNSWTARCARPAHGRMAAAARPGSCAPPGRPGGRGTARCLRTGRGCRATGAGRPWTRPARSRWSPARRGRRSAIAAPARGPRGSVRPHPAAGAGFPRHLRRRPECRPGRGGWKRRCAPRRSWRWREC

SEQ ID NO: 30373 - protein, 189 aa, Pseudomonas aeruginosa
PSVTGMPVVSVSSTTLRIYRAFLCFAAAAAAERLFRCGRSARQFGDATVGQLVGPLVAGIAGMPADPLPLHLVPGDLLIQGLPEVGILDRLLAGGLPAALLPVRQPFGDAAHHVFRVGDQTDRTGTLECRQRLDRRHQFHAVVGGVRLAAPKLSLGALVEEQRPPAAAPRVALAGAVGIDHYLFFICHA

SEQ ID NO: 30374 - protein, 243 aa, Pseudomonas aeruginosa
AILCANDFCLATSTHDTDRRPVRLQRQLHLAVARCDKPSLRGGRPRRRQAGGSLAGRPSRLAVERYPGDPPPSRPRRRRRGPEGTDRRAGSRPGQREDPGPRPGAGRRRTGRGARPGLRDLPRARPYPRPYRLLPPGGDAAAVLRRHPVRRRLRPSLRRHPGADASFPGATGRAAGQHPGLLHPRVHAEQPALRAGGGARQRSAAGTLRGSDPAARTGPHHPAVGNLAGIVDQSISSRFGKIC

SEQ ID NO: 30375 - protein, 543 aa, Pseudomonas aeruginosa
IFARNSTQPMPPQTRKTPDLDALARAVRVSILLIAGALAGCQGSGQIKGEAQAKAARPGARAVDVQFNPSWLHTQPGQNAAYNDIWDRMRDGFQLQDAISTNPRIERQRLWFLSNQSFLEQSSARGSLYMHYVVERLEERNMPLELALLPVIESAYNPFALSRSNAAGLWQFIPATGQHFNLRQTNFYDGRRDITASTNAALTYLERLHDMFNGDWMLALAAYNAGEGTVSRAIERNEKLGLPTDYWNLPLPQETQDYVPKLLALSQIVMAPDSYGISLNPINNEPYFQAVRVKRGIDLSSVAALANLDEDELYQLNPAYKRRVTMDGPQQLLVPMEKAAFLTASLDTLKPKEVTAWQQYRVRSGDSLHSIANRYRITVAELKSANRLSSNHLRKGQQLSIPGQIAGGAVKPVYQQLARQASTPARTRSYKVKNGDSLWQIARNNGVDVNDLKRWNGLDKHALKVGQTLKLQGGTQALAARKGNAAGKRDSATYYKVKQGDSMYLIAKRFNVEMKHLQRWNPRSKQALKPGQTLTLYLDTASR

SEQ ID NO: 30376 - protein, 429 aa, Pseudomonas aeruginosa
RFVVKNSQGPGHTPDASPLLPDPRPGREPAQLRRDYPEPWLCPIRHAQVSGQFPALRLDQSRRPQRRHLAPDGLGQLRHAQPLHPERHQPDRHRRFPPVRSQRAERTIDGGHRPVRPVRRRTSLQLWPDREERGIRGKPQLGGIQPAAGSALPRRQADHRQRRGLFLSHPGQAGAPDVPHLPAGGEAGRYPHPPPGAFRPAALRQPAADPAPGRASGAAAALLEGSRLPRHHLHRAAGQRSLSHRRGRSRAPPGVRTREGLVGRKTAGEPRQIQFRPGRGGLLPGQRRRLRSLQGRRVRLLHRAPGEELAEQLSLPRGSARRCDPHGNPAPDPQPDPGVVHEHPSRRVQGARATPGAGRDVRLRMDQSRPLQQFLPALAQLLPEQRIRRQRRPGGPGMAVPVAVPQAIAGAVVQTAVQPADHRGARHSP

SEQ ID NO: 30377 - protein, 784 aa, Pseudomonas aeruginosa
KGRTAALRNPAGQSEPGAYSPALSRKPRQHRHRRAPAHRRPRPIQAAPGPVRLRHDPHDPATDPQSRPGTVAVLPLQPGEGQGQQELRGHRQPGGRRHAQPPARRPQPRRTGRRRARPGPDLALAVLQHSQLVPQFAPSGVPQPLRLRRHPALHPGPARVVAEKPGDVPMIRPRFTPLLAALLLGCCGPLLAAPKHALTLYDEPPKYPADFKHFDYVNPDAPKGGILRQADFGGFDSLNPFIGKGVSAPSLGLIYDTLAFQSQDEPFTEYGLLAEKIEKAPDNSYVRFYLRPQARFSDGTPVTAEDVVFTFETLVSKGDPMYRNYYADVDKVVAEDKLRVRFDFKHAGNRELPLILGQIAILPKHWWADRDFSKTGMEIPVGSGPYRIAKVDPGRSISYERVKDWWAKDLPVSRGLYNFDTITIDSYRDMSVALEAFKAGQYDVNLEYSAKDWATGYESPALRDGRFIKASIHNHNPVGMQGFAFNIRRPVFQDRRVRQAISLLFDFEWSNKQLFFSSYKRTNSYFENSEMAAHQLPSEAELKILEPLRGKIPDEAFDQVFQNPVNDGSGVIREQRRKAYQLLTEAGYRIENNRMVGPDGQPLSFEFMLFQANMERVILPFKRNLAELGIDMQIRRVDVSQFVNRLRSRDFDMTSATWPQSNSPGNEQREFWHSSSADKAGSRNFIGLKDPAIDSLVESLIQSDSRQSLIDHTRALDRVLSWGYYVVPNYYVDTWRVAYWNRFGRPKVTPLYDWGLMTWWQTSDKALPSKAQAEATQDAEPERE

SEQ ID NO: 30378 - protein, 362 aa, Pseudomonas aeruginosa
RRMLSYILRRLLLIVPTLFGILLINFIIIQAAPGGPVEQMIAKLEGFDAASGGATGRISGGGGEVAVAGSQYRGAQGLDPELVKEIERMYGFDKSAPERFMIMLKNYLHLDFGQSFFRDAKVTDLIIEKLPVSISLGLWSTLIMYLVSIPLGIAKAVRHGSVFDIWTSSAIIVGYAIPAFLFAILLVVLFAGGSYWDWFPLRGLTSNNFDQLSLGGKVLDYFWHLALPVTALVIGNFATITLLTKNSFLDEIGKQYVVTARAKGLTERRVLYGHVFRNAMLLVIAGLPAALLGIFFTGSLLIEVIFSLDGLGLLSFEAAMNRDYPVVFGTLFIFTLFGLVMKLISDIVYTLVDPRIDFENRE

SEQ ID NO: 30379 - protein, 227 aa, Pseudomonas aeruginosa
SPTTSTWSGASPTASASCNKGGSSSRLPARNSSQPRDTPIPASCSTPSPAVRRRATRPVKPCWRWTTCGSGSRSAKACSAAPWTTSRRSTGSISNYPAGRRWASLAKAARASRPLAWQSCGCWKARAASASKAPGWTVSRNMTCARCAARCRWCSRTHMAASAHACVSARSSAKACASIGSAARPNRSRRSSTRWWRSGSIRRPATVTPTNSPAASASASPSPGHWC

SEQ ID NO: 30380 - protein, 776 aa, Pseudomonas aeruginosa
WAWPRPAWRPGSATWPAAWARKAPGSMRFPPGRSERSPPPGSRASARCWPPTSGRRRCGATSPSRKSAMPAPSSVRTWPAVSAARSSTSMAASTLPPWARWTTTDHPAHEKWPLRAAFFMGGIKKRPRKRPFLCISVSVFLDFRLVLQLTAEGGEVCLSAARSQEAAVHGLLVVGDSLLRLADAIQADHHVIAIGQGHARERRLVLGLRTLHAEHRLEQFRIDAFLAAGGRLDHFPRLPRCGRGTAFTQLCDQGLATLLRLLGGLFGGQALADVRRDLLQRLLLRLVVFLDPQHHHGVRIQLDGATVGRFFQHLGAERGLHDLAVGSDAVAPRTSERLAGLDLQAHFLRRLAQVGGFVGGAFQVLGSLDEALLDHLFLQFVLELRLEAFQARYFRRLHAQQLDQVVAVRSLHRGGYLTLLQRIQRLLERGVVHAAAGVAQVAAGGGRADILGELLGQRGEILALGQASLDLVDLRLGLLVADLVVHLDQDVGGIALLGEVGDFLLVQRLEVFLLHLDLVEEGGLLQFHVFDDHLLGSHELALVAFVEGLHLVLAHAALGSVGLDRQGGEVAGLLLEASEGLQFVVGDETGARQAGAKLADEHFLAEHLAELHAAVVHLADDLVEAIRVELAVDLELGSLQDQLVQRLVGEGELVVLGGLEQQGTLDQPLQGRFLEQLVIQHGWIEILAQALQQLATLHVHGLLDFIETDIVAVDLGGHVGVVGGPDDRVEAGQRQENDDHANDGLGDPALGIIPDVLQHAAPKNCHDQPSWAARRG

SEQ ID NO: 30381 - protein, 141 aa, Pseudomonas aeruginosa
LAERTGLEPATPGVTGRYSNRLNYRSAARPALADLGRTSPKRRLVDSILQGFTGFEARDLGSGDLDRLASLRVATGASSALFDSEGAETNQHDGVTSLQGASDGLDHCVQCATGNSFRDISRCGNCIDQFRLVHSKSPYFC

SEQ ID NO: 30382 - protein, 164 aa, Pseudomonas aeruginosa
QGPKNSVKNTYRLMRANSLLGIRLAFFILCNHLRSRIGQGLRGVLQRNLQDFVNPFNRFNNQITLNIVRNFLQVANIFLGNDHRLDPAAVRRQKFFFQPADRQHLPTQGDLPGHCHVGAHRDLRDRRNQRRAHADACARAILRRSAFRNVDMDVALLVEVRRDS

SEQ ID NO: 30383 - protein, 634 aa, Pseudomonas aeruginosa
ALGAAAHHGQRRGDRFRHHVAQRSGLGQLALAGYHGRLDGEQLAADLGPGQPGHLADLVLLFGEAITELAHAEVVLQRLAGHHRLDTLELGMLLHRLAADLGDLPLEAAHPGFAGVVTNDVAQGAFLEGQLALLQAVGLDLLRNQVLGGDVDLLVLGVARQADDFHPIQQGRWDVHRVCGAEEHHVGQVVVDLQVVIVEVVVLLRVEHLEQRRGGIPAHVAAHLVDFVEEEQRVAHADLGHLLDQAARHGADIGTTVTADLGLVTHAAERHAHELAIGGASDGFGQGGLAHAGRPHQAKDRALELLHPLLHGEILENALLDLFQAVMVGIEDVFRLGEIMAHLALGLPRHVQQPVYVGTHHGGFRRHRRHLLELVQLGSGLGVRLLGQAGGVDALLQLLDFVVPFVDIAEFLLNGLHLLIQVVLALAALHLLLDPAADALFHLQQVDLGIQQRQDMLDPRRQVGDLQDVLLLLDLQRHVRGHGIDQPARLVDAVQRGKHLGGDFLAQLDVLLELAQQAASEDLGLALADIGVVDGLDRGTNVPFFLDEALDLAALLAFDQHLDGAIRQLEQLQHGSDRTHAVQAIFARIIVRGVFLRQQEDLLVAGHRCLQGLDGLFPTDEQRDDHVRVHHHVT

SEQ ID NO: 30384 - protein, 135 aa, Pseudomonas aeruginosa
IIRGCDEPSMTLSSMTTLLTSCWEGISYMVSRRIPSRIERKPRAPVLRSSALRATALSASGRNSRSTPSISNSLAYCLVRAFFGSVRICMSAASSSSSRVAITGKRPTNSGIRPNLTRSSGSTSLNASPTFLPIS

SEQ ID NO: 30385 - protein, 143 aa, Pseudomonas aeruginosa
RRRRRRPGSRSRRSHLRDQRLPGRTDPHRASLHGARSDQPAAQRHSPRTLARRNRPPRSRRQLSDTGQRRRPRDTGGRPAEDLRTLFAPGRQPRSQHRRLRPGPGDRPPGRAMARRLCGSAGNAARRRLLPPDLGATPLTAEA

SEQ ID NO: 30386 - protein, 623 aa, Pseudomonas aeruginosa
HGTPRLSARCSMFRAMHLSLLGCLLGTSGCHGLPPAPPAPSAAVGNYGEVIDYLQRHIRREMERQDVPGLALALVDDQQLVWARGFGYADRQHRINASEHTAFHAGDLSKLLIASATLQLAERGQLSLDAPLQDTLREFYVRSRFHADQSEADRAITFRRLLSHQSGLPGEHLPPLFGERPSSLGQLPAKVSGVWLSNPPGTQVAYSNLGYELVGAAIERNTGKHFEQHMREHLLDPLQMTRSSFARNALPQAQRAQGYSGGGRPGSAAASDLPVNDLWSSPVDLSRFVRMLFANGRHKERQLLRKHSVEEMFRQQNAGNALDFDCQVGLAWFLSPCGSAPLEGGIRHYEYASATRGFSAHLILLPEQRLAAIVMSNADDSGSLTASLARQAASLMLQVKQGARRPAVQPTPARAPALKVPSPEDRRQLYGRYATRQGQIRLYERRGRLYADFGEQRVELLRDTSGWLQMRKRLLGFWPVGVDSAGQLQLDVVSYGQRRILVSRRHDQTAYLGERIEPTSLPQAWTEAVGTYRVASTGRHSYLNGLSIRIEDGFLLVRGQAGGTRSGEFILQPIDSAHAVLAGSGQGLGDTFSRDFDGLNALGYRFAQQDTKARPWLQRKESP

SEQ ID NO: 30387 - protein, 129 aa, Pseudomonas aeruginosa
NIACFLPIRRMAHPAGLEPATIRLEGGCSIQLSYGRFIHLHSMLSANFKLWQSQSQQPTCFTSYPASGCARQAGRMLYRGRKAVNGFFKKIQLYKGVTANPRVASFAPGGVHAKMRVLFPPDSMVTLPT

SEQ ID NO: 30388 - protein, 179 aa, Pseudomonas aeruginosa
PAPACWKIPCTPPNTCTTEVAGNEKPRVRGAFHLSLRVQSARRQVVPPLPSSSTTPMAVSRSRIRSDSAQFFAARASRRAWISASTSAASTLPSAPACRKASGSSCSTPSRPANCFRRAASAAAADRSLSRRRLTSRASSNSTEQAPAVLKSSSIAAAKRSTYSAASAGAASGSPLSAL

SEQ ID NO: 30389 - protein, 537 aa, Pseudomonas aeruginosa
STATLIGRPNTRWTSTASPPGASCSATGTARAGPWRSTPTAIARRPSRSDPPQARHAGLSAKHYAIRIFSAVHLDVAGHLSAGSRSPTPHQGMIVIISKGNLIKFVAAPLGMLALGFGLFNGVFFYNEAGFMTHVRTIFGDEKIVDDVGYATKWFGRATTWKKAISVQSVLVMDDNDTNPDNDGLGATIEAFPIVFLGNVDAKVESSARFRLPGGEPFLKMAQEYRNPDNFIRTALVPAIKETLQATASLMSADDYYAGARSEFAAEFENQLNDGLYLIKRKEVRGPRGAIPHQTAILQAGTEQGAFGDNNASQFVTEKVTDAKGIPVRKQQQFRKFGVEVVEARITNVDPNPQYKQRMVKVQQALAELAVARQNRLKEEEEKLLVTARGEKEVEAKRQETLRDQIERTTQAETDKQLAVINAEREKQRAEIEKQTAELLRDKATVTAQATKITADAEAYAREAVIKADGALQPKLDALIAINKVWAEAAAQAPVPSVMMGAGANGAASRQDEIGQLMGVLATKAARDLALDLKVKD

SEQ ID NO: 30390 - protein, 266 aa, Pseudomonas aeruginosa
SRQQKKRPAGRFLVSGSGHQAHRVAAVEAEFVVRTADQLGLLGPHHLDRPLHVGLVAVLVGQLQVVLEMPRLGLQQTAVEFRQLRVQVRHQGGEALAGTRLDEGADHQRIGQPLRLMLAHQVAQRRGVAGGADIDHRDTAFLQDRQHLLEVAQLLARQAAHLVHQVQAAGVLADQLHRRRRGLHLAGLVVQQHDVLALQGRLDPGGGSGTGKELVDLGQHGAGHSFWKGPAMTLVGAGKAEHYTEAAAVGQADPFDMHQEQRLDCV

SEQ ID NO: 30391 - protein, 915 aa, Pseudomonas aeruginosa
NFENSFCLEPADALVGWWITVHLGLTSGSASVPGYVSPGTTDEGNTVLEAYRKHVEERAAQGVVPQPLNAEQTAGLVELLKNPPAGEEEFLLDLITNRVPPGVDEAAYVKAGFLSAIVKGEATSPLIDKQRAAELLGTMQGGYNIATLVELLDDAELANTAAEQLKHTLLMFDAFHDVAERAKKGNAAAKSVLQSWADGEWFKAKPEVPEKLTLTVFKVPGETNTDDLSPAPDAWSRPDIPLHALAMLKMARDGIEPVQPGSVGPLKQIEAVKAKGFPVAYVGDVVGTGSSRKSATNSVLWFFGDDIPFVPNKRAGGFCFGTKIAPIFYNTMEDAGALPIEFDCTNLAMGDVIDVYPYEGKVARHDSGEVVTTFELKTPVLLDEVRAGGRIPLIVGRGLTEKARAELGLGASDLFRKPEAPADSGKGFTLAQKMVGRACGLPEGQGVRPGTYCEPKMTTVGSQDTTGPMTRDELKDLACLGFSADLVMQSFCHTAAYPKPIDVKTHHTLPDFIMTRGGVSLRPGDGIIHSWLNRMLLPDTVGTGGDSHTRFPIGISFPAGSGLVAFAAATGVMPLDMPESVLVRFKGKLQPGITLRDLVHAIPYYAIQQGLLTVEKKGKKNIFSGRILEIEGLNDLTVEQAFELSDASAERSAAGCTIKLPEQAIAEYLKSNITLLRWMIGEGYGDPRTLERRAQAMEAWLAKPELLEADKDAEYAAVIEIDLADVKEPVLCAPNDPDDARLLSSVQGRKIDEVFIGSCMTNIGHFRAAGKLLDKVKGGIPTRLWLAPPTKMDAHQLTEEGYYGIYGKAGARMEMPGCSLCMGNQARVQTGSTVVSTSTRNFPNRLGDATDVFLASAELAAVSSILGKLPTVEEYMAYAKDIDSMAADVYRYLSFDQIAEFREAAANAKIPVVQA

SEQ ID NO: 30392 - protein, 197 aa, Pseudomonas aeruginosa
SSDASNKPRPVRGFFLPGETPRAAWHSACCGSYGKARRRRRRRTGKRDGPRRPPALEVVMTDRAIRSQAWAGGSDAPEKSALDIGFMALTDSASLIVAATQGFAQPYGLTLNLRRQPSWATLRDKLLSGELDAAQCLYGLVYGVQLGLGGSAASEMAVLMGLCQNGQAINLSEPPEASWRDQCGRHCSGIGARMVHA

SEQ ID NO: 30393 - protein, 276 aa, Pseudomonas aeruginosa
PWGRPFPTGTHALWLNYWAPEHRSAYAARRAQCGGSTGADGRPSPGRAHRRVLRRRPLGRPGRGPGPGLHHRHQPGDLAGPPGKGPRHYPRLRRRLPEHRPRAGHGGPRRQPLHRTERREPPGHRATDQRPRLCRRSARRDPAALLRPLPGRPRQRLAGPTSAAFLRRRRSQPALALGWHVVHDPVPPLGPAARRPGLPGHRPQGPADRAVPRCRDGPWATPGRRRHAPLDADRRAHLGRQRPRRLRPQLPDPRPGRNRPGHRPLTLVRPPCCVSC

SEQ ID NO: 30394 - protein, 105 aa, Pseudomonas aeruginosa
CAAPSSPGSAPTSSKASRPAACNRSSTWPWRAFESDQALRAQLQAREAQLAERKRIELAKGLLMKMKHCGEEEAYTLMRRQAMSRQQKLIQVAEQIIAMHDMLGG

SEQ ID NO: 30395 - protein, 306 aa, Pseudomonas aeruginosa
PQRVDPRAGTPGRALQLQPARHLQRRVGGARTQPGRRRGRLLPDPRQRLERPVALFQGRRLRERQRRRQRRRQPRDHLPPEHRPSLNRRRRTDAPPQPCASPRRLPPRRARPTPWLSLQPLYAALSTTWQRACYVLPDGSQRRLPIPDKDVARPLLPGRGPWRLRRFAPASGRVGGPLSDAHLVAMQLPPGGRSAPIPLDTRCSMNNSFWKAGHAPTLFAAFLYFDLSFMVWYVLGPLGVQIAGDLQLSTQQRAMMVATPILAGAVLRFLLGLLADRWSPKSAGILAQVIVIGRPRGRLAAGREQL

SEQ ID NO: 30396 - protein, 694 aa, Pseudomonas aeruginosa
  UNSURE (334): Identity of amino acid at the above locations are unknown.
AGTAAGVVPRLRRGILRRGPAARIAMVPAATPGQGHGHRRRGQLRHRARRPLRPRPGRRVRLEQRVRLRPAAARPDPPGVRHGRAQRPAAAGAQGHGRLPESPRRPRQLVVHVLLQRHLRRLPRPGQHPARLFPRPVRPEPGDRRLLHRRLRLRRQPDAPARWRPRRSHRRHPQPADGVHPGRHLHRRGRFPLVQRDGRPRPVRGRHAQSRCRQWRGVPVGTAALPQGNRRDDRADRHGRRHRRLLPDCRPRRDQAKHRRLPARPVAVRQSRRAGLVRPPRGEAALAHHLGARPRSPPRGSERGAATEHWRGQRLRASHGKPGCAAGGHPGAGXGRQQGTPAGHRRRCQPVRRWRPGGAQQPASAGPGLLCDSGNLGHRAVPGPPAAGAEPLATGQRRRPAAAHHPHRPGAARHPLHPGPRRRLPGLPVARRRVAPADQRPRLGTAAHATRADPRPGTGPASGGRLSGRRSGARQPVATGQRRRLGDAGRQRHPQHPAQRRGAAAQRRGPGSRRPPGRQPGQRQRPAGTRGSRARRQPRRRPRATGPLATAATAEARPALRRLAGPAVARRIPPVPALPGRRWPGPTLAAEDPSRRTCRRSAGNPGPAARGMVPAPRPGPAFPRAVRIGATPASVLPDARAPRRDSRRALAQPWPAVAAGVAGAGQPAAARAWPVASTQPAAPRPQAGKSPPRP

SEQ ID NO: 30397 - protein, 894 aa, Pseudomonas aeruginosa
AIAQVGTAPAWVLPTIDNKAPASTTRRRFPTERDLDKGVLLATAGRLFCLRQPYAGATPHEEDQAGDGRQRHGRGPYPGRTAQAQLGLLRHHGVRRRAPSQLQPHPAVPGAGRRADLRGNRPQRPQLVCGKRHQAPPRPQGGADRPGPPQGGRRGRQRGRVRPPAAGHRLAPLHPADTRQSPAGRDRLPRHRRHPGHDRLRPDPQPRGGDRRRPARPGGGQRPQATRHGRDRRAPLRLAAGTPTGPHRRQTPARRAGSPRHPLPPEHPDPGTDGQRQRPGLCRAVQRRRRDSRRPGGNGRRHPPQYRAGRKRGHPLQPRHPGQRHPADLRPTHLCGRRMRQPPWHRLRPGCAAVRAGQGLRQPPGSSRLRPLPGLGDLDQAQGDRYRPVLRRRLHRRRRQRNHHPFRPHRRRLQEAGDQGRCTGRRLSLRRHRRRRLVLPADPREPQRRADPRPPDVRRERPRRCRPPGPEQRREHARHGRSMRLQRRLQGHHRQGHTRTRPVQRRRSQETHQGRQLLWLLRGIGGTDPDQHRRRRRRRQAEEREGHLRLQRPQPRADPQGHSRTPADQSRRRHALHGLEDPERLCHLPSGPELLPDLDLAGRSQGRSAVAPDQRTRPRQHPEGRHLLGGTADVGWRDQRRRVAAHRRRRRQVPGADGQGHRWPAHRPAGGEEGRPAGHLERPRHALRTCLRQIHPHREDLRRQRVLPLRHAELDAAGHRSGTRPVQHVVAAQGQAGGLRLPAQLRRGRDQGRRHHRRGLRLGDVHRRQRRDQDRGRGVLRQAQDRRRGARIQRRLPPALPRGSLLSGAHGALPAAGRHGAHPQGGGRGRGKPQGAQRPPAIRPVLRAGPMEAAHRTAAIEEGVRTDSAQATGKRLNPLSGPSHGGPPPTGVNR

SEQ ID NO: 30398 - protein, 540 aa, Pseudomonas aeruginosa
STASEWPVRCTTGRSNWRAAKPWPRTRAAPIATRCGWRTGGCCSAWTAWRCAPDLSPITGAEHVDRFPAAHHRFDLLLLRRGLWRPDRTRRRTHPRRARRSSAPGQLRQTLQQRRQPAPDRRPPGPRAVPPTAPRQATGAGSQRLGECPGTCRRAFRRDHSRTWAGQRGLLYLRPVADRGLLRLQQAGAGPGRHQQHRQQFAPVHVLGGGRLQAQPGRRRTAVQLRRPRLRRLRADRRQQHGLRPPGPVPSPGSRQGRSAGDAHRGDRPAAHRHLRAGRPAPGAAARHRRRTVPRHPAYPALGGLDRPFVHRRAYRGFRRPEGTGARLHPGRRRRHLRHRPRRPAALRRMDRPFAALPFALVHGAQPVQRRQRQEQRADQPAPGYRQDRPRRMRAVFPHRPAERHGRSRDRQPGQPAARPPRSRRSRPSRRGGALLGCGTVAHVPRSQRHRAVRCGPRRPDQGALDRLYQPRAIAAGPAQDPRGPCPLSLRGGPGSLRRHGNLPIRRPFASSRILGRKGRLRDQFGTADQSCPSGRSAPR

SEQ ID NO: 30399 - protein, 468 aa, Pseudomonas aeruginosa
TVGQRHKLSLFRQQDGLDRTYLFNSAFNVTHFHLLSDLIQLADVDSCNDLPGDLAAAQAQGQRSGQADGDQGDGDDVVEQVGLDLELPHRHRDADDDDQPLGDPPQAVRVFEADAVRRAAHDAVHQLRQEHADDQHQGRAEHLGQVQGEDVQRGGYPLQAERLGGGYEEDEQYEPVDDLADQRRDRNLDADPGQQLGQAGATHQPVQAQLGQQLGKQRIEQLGDDEAEQNDHQGAEQVGDEACQLAPQGVHRGQQALGPDIELHVHSALSAEDAFFAEIRETGARCGEPLLMPIISACSQCPMRLNRSPAPTWRLAVFSTRPRRASSSGWGAEALSRSRRDSSNGSCMRTSCLYEGVTPSPHPRSRQSQRSRRNTHHWKVATPPISRQASQNPCGASAPGMPPTLIPSRPVTKLIGRKKPVIIPRRYMVRFIRSVIRRDSASCRTLMRSRINSSSSRFRVSRLFSSFQ

SEQ ID NO: 30400 - protein, 135 aa, Pseudomonas aeruginosa
YTTSDAVFGPFPASRSSSRSATAFSGRRRSEITRRASANTRSETMSSGSAPGFRFTPRRNTSRLSAPRSSKRGRVASSSSRSQANSLSPAESRSQACASGTPRSQCSQRLSSGSRSSTAIWLRPTRRPPPRPLRT

SEQ ID NO: 30401 - protein, 155 aa, Pseudomonas aeruginosa
FRLPIRLAPRSTRIRRPPAIAGAASAPPRARPLAGPPCRSASRYARSPRRSQPRVRATGIRARTRRTARTTCDRPRTGPAGPQPRRPPIAVRRLRRAPSTSRCPARRSGRTAHANAGPPAPGRPARLPAPAANGFRTAHRRGAAAGARGCLPWAT

SEQ ID NO: 30402 - protein, 154 aa, Pseudomonas aeruginosa
PGRQERGDYCFACLSCTGGTKKGGVTRPFRIQRGPIRPGLAPRQGRTRYPAPSRGSARRSRCPAPSASGPGPGGPTDPGRRCRCTCRPCCRQRWRWPAASSPPDCARRTGGQRCRNRDPGPGSAGSGRWNRWRSHRRTRGTRRPAGRSTAVRTS

SEQ ID NO: 30403 - protein, 225 aa, Pseudomonas aeruginosa
NAARMRLAGRPACPACRAQVDDAGFSVTDWTAIARSTRRTRHQPGLMKLKPLAPLLCLFIAVPGLSVAAEKTVYGLNEYARINDPDIQLAAKLDTGAKTASLSARDIKRFKRDGETWVRFYLATDNADDTPIEKPLARISKIKRRHGDFNPDEGKAYTARPVIELQVCMGKAIRTIEVNLTDRSAFQYPLLIGSEALKKFDALVDPSLKYSAGKPGCKPDAKPAE

SEQ ID NO: 30404 - protein, 179 aa, Pseudomonas aeruginosa
SAPRAPRAGSASCACGPSRPPRCSRDCRSRCERNPCPRRPRRRCIRRSARRWAGRSRRAGRRPGRRHRSCSARCRWHRSRCSSDACSPLRCCSPATAWRCPPCSAPAPGRSGRCAAAPGAAGGRTGRRRRCCAPRHCRPPRSGSARRRPSPAKMPAAPGRRRKVRWMRASCSSPQKVVR

SEQ ID NO: 30405 - protein, 154 aa, Pseudomonas aeruginosa
AVPPASRHPARPSPAVVRRARRHAGPARRAGRHRPATRVRRPGCAGRIPARPGCAPTRRSPCPAPDRHSPCRSGIRSGWSPPAGTRCRRLSGPPARNRWRRRPRRSRRAAHAPKPARRAGWRGTPAGCSEPWTASDGRPSGRLRACPGRATPGP

SEQ ID NO: 30406 - protein, 771 aa, Pseudomonas aeruginosa
RRLALGGFELLEQLANAVAFLDEEAAHPFPFGIDQAFAEQAVGPFLVAQALIAERRQDIQAQALQAVPAGLQGAAQLSDLVQRLAEMSSPLQQAHAAHAQRPVDRVEGHVAVVCRHLVPVHALQPLLGALQAVGAAVLEDQVDLFGHGLGEEAPRLIARGQGLHRRQAGQRLLRPSQQALGARQADLSLGIEIDRIDHIHMPERPAQALFQPVQLDPVVGGQGLGDGRQRQRAPGLLEQRPGALAEPLDEQLRLFHLALLECEDHLDVGQLHVQVAPFEEMIALLRQPQQAPRLVALATDHLGQRGGDQHRHFEEGSVLPELDFDPASQGDAQFQIVLLQRHHRLHRQRGEVLVAHRPVAAALPPARQQFVDDPVGLAQAEVAGPRPDIGKDQDRIALGDFVRHMLAPTVDQAELAAVDQFQSASVDQRGDHLRVFRRTGMLDGERRHVVVGEPQAGVEMQLLETVRIGVTQAVAEEVGEQQVEAIPLAFAIQRQEEQLHGLQALQQRLAVLAPGQGVGQVAAQLAGNAKGQQRFLQVARQAFEDRRQQIGADRLLVAVEQGHFLHLRLLAQPQADEMHAHHPAFGLAIERLQAGLVQIETAALEVFAGFLEAEAQLLEADFQQQSLGPPGSQAQRRLRTRAQGQDQPGRCVLHQAVEAGEDVRVANQVQVVQHQQQRPRIAIEIAEQAFDHRHHRDPHGVLQVGLGVVAKLRHGFAQRLDELPAETGGVVVFFGQRQPGHRLVCYSALPGQGGERAGLAEAGRCGKHQNA

SEQ ID NO: 30407 - protein, 153 aa, Pseudomonas aeruginosa
AASPANWRRARTPSTCWKAASPAARSPARRRFAPCRSSTNWNRADAASTAAACSTSTCAARWTARSPSAPCWSGTARSVAGAAAASSPTRTGRTSTRKPWTRSGCCWKPWKGWPGQRPRNRKEPAFRGLFHRRRGYRLSERLEALRNSRLRSS

SEQ ID NO: 30408 - protein, 219 aa, Pseudomonas aeruginosa
SGMSRVVAFKASIPVFSANAIQISGTSTPSRSRQAISTGLSSKFSERWGDDGRGTLAPRRGQGNAGLFLESRSTGVNGYLGPYAALCYHSRHRAQQRRPAPGPQPDEPAFRPSRPRFQPCRQIPPGHPESRLRALRRRAVDLLQRRRGRRPSRHGLEAQPQREGVQPRHRSPAPGNLSFHRPGPRTLRHRHRRAFPRPAPARTPGEGKGPVQLLPGRPR

SEQ ID NO: 30409 - protein, 544 aa, Pseudomonas aeruginosa
FCTLFHQPTAGLQVATTVLQHRHQVHRYLRQLHQTRGSPAQRRVELSAVAMAAGDDQVHGQLFRLIEDHLRRVALHHPHALDQRRILGQLAEFIAKPFQDPLLDAFHDVVQPLRPQVLETLGVKVGLQDRLGEQPEGLHHMDDIELGVVGAGQRQGVLQDIGSIEPQIGGVENRTNHAASSTACAAGLISRLAASIHSPSVPCCFGLFPARWGKSLFSLRARRRLVAALGPSARLCFEEAQRLVQRLDPGHPVARSSSAGQGRGIDRRQLQWPPMGEVVVHARPIVGHPLGRRQQLVRIALRQDEAAGAGSTDDFLHDRLDQRPTVRVGHQRRGAALQQYRQPVVGDVPDQLLPARLLQVGHRRGLQPGLAEQRGTLLDDLAPASLVGRSGMIAEIHSAVGLVLDHARFAAMHTDEAEAAQQMQAFRQQRPQPLLHAQTVLQQQNLGSRRRRCADQGCQFVIAGGLGAHQQPVAGRHVLRRMVGLDRRQAPEAMHRTIQAESGAIDRLELAAQEKMHVVTGMRQHQSIEAADGSRTDDADPLLL

SEQ ID NO: 30410 - protein, 240 aa, Pseudomonas aeruginosa
GLRHSTKRNPAMSELISYQFEDGITTLTLNNGKVNAISPAVIDAFNQALDQALQDKAVVIVTGQPGILSGGYDLKVMTSGPENAVNLVAAGSTLARRLLSHPYPVIVACPGHAVAKGAFLLLSADYRIGVDGPFQIGLNEVAIGMTMHHVGIELARDRLRKSAFTRSVINAEMFSPAAAVDAGFLDTLVSADQLQESARAAAQQLKKLNMTAHRNTKLKVRKALLETLDQAIELDKKHLG

SEQ ID NO: 30411 - protein, 211 aa, Pseudomonas aeruginosa
SLAATARPAIASASPASSNVPPSDATRWPTRCSTRSTPSPSCCRAPTFPRPRPIARPTPSCRSRAAATPPSSEPGRWSIACSRRLRPDPSGPNPGPATRTGRSAKASFLSIVNSATIRYPIEFFSAILCPSEVSITEAAMKRRSPRHYARNTALATLGLYAILMLVVLSLVAGAESARNATPDNDTATTFSNQIGQALPGLLSGLNSRRAG

SEQ ID NO: 30412 - protein, 88 aa, Pseudomonas aeruginosa
TPASFPGNSMRRQTRKFWIVAALAILTNGYSLLGLAQGSAGALARTIECNQAMVRALAANLALKLQSGTPPARPQRWIPERFILDCPA

SEQ ID NO: 30413 - protein, 134 aa, Pseudomonas aeruginosa
AAPPAWRTPLRRGPASAPRGHPRGDAAWTGRRSARRHRSGQAARPGRVAPVEARGQRRVSPTRRGSTRLPPCRRTSAGPVRPSGSAACRRFALRPAAHAPAATRASTRSPLPGTAARGPPRPRERSGCTGSASR

SEQ ID NO: 30414 - protein, 373 aa, Pseudomonas aeruginosa
RRLRRSSSSSSVPRMMQPVAPSGWPMAMAPPLTLTLLSATPMSFMNFITTEANASLTSNRSMSSTFRPALARALRVAGAGPVSMMVGSVEVTAVATIRARAFRPSSRPLASEPMSMALAPSTIPELLPGVCTCSMRSTWLYLRSAVASKPICPIISKLGLSAASPSRVESARMNSSWSSRTMPFWSATGTSDLPNSPSARALAAFCWERRAKASTSARLKPSRVAIRSAPIPCGTKLVCRLVSGSSAQAPPSEPIGTRDMDSTPPTRTRSSKPERTFIAPRFTASRPEAQKRLICTPATCSSQSATSAAVLAISAPWSPTGVTQPSTISSTWAVSRSLRRWTARNSPAIRFTGLTLCSAPSFLPLPRGVRTAS

SEQ ID NO: 30415 - protein, 281 aa, Pseudomonas aeruginosa
PADARGTRMPVTLPRLALLGALLFPVAAAWAAELRLELPGGTQTWSSEELLRHPQARDLDIPADVAYRRNMRYRAVPLAALLKGVHPEDHLQAVASDGFAAELPATPLLAEQGSQAWLAIEDPQRPWPPLGAGKPSAGPFYLVWSKPEEKRIGPEQWPFQVVRIRYQSPLAERFPALLPAADASAEVRAGFAVFQKNCLACHRLNGAGDAQFGPDLNLPYNPTEYFQPQFLARYIRDPQALRQWPQAKMPAFPERVIDDQELRQLIGYLRHMAGRKAGAAG

SEQ ID NO: 30416 - protein, 285 aa, Pseudomonas aeruginosa
RPQQRAPLVVAARGALVRPGERRFALGLVARIEQAQGIVGAFDEGSETDEAERIVAHAGGEGRAAEQVRAVLHPFAETTDAIAQDALGGDAAHFQPGGVDVLPHVQGDPPAYRMGTGARCGQAAVDARRVVRVEGEETQQALGGQFAVALQVGVEGAGDQQRHGQFVQAAAVAVLRQQRQRVADVEHAGEVLRAFQVARHPVQVGSGPAEHAYSSTTQVSLVPPPWDELTTSEPSRNATRVSPPGTRRTRSGADRTNGRRSIWRGATPLSTKVGQVDRDSVGCAI

SEQ ID NO: 30417 - protein, 545 aa, Pseudomonas aeruginosa
PRRGEGTDQARPRRQRAGRHAPGDPGRCRHEHERRSLLDLATEAAGGRRDRPGRHRSRLPRRAGGEVRPRPVRRSLPAPGQAGRPAVRHQRREPPAPPGRPRGGSRRTGPAEEPRRSAAAEETGADRRDRPPGQEPARRHRQLVGSRRATPGGNRLPGPGQCRRRACHPALRQGCQRQWRPGDPRLPEQLQPGSRGRSALRRGDARGGLAHRARRRPGGRRGRRIAGHGPRGLQSHRPAHPGQPAAAAEGTEGHRQAAGAGADERPTAVAGLGAGKRRCDPGNLVQWHRRRQCHRRRAVRRAQPQRQADHVLPALGGPGTGLLQPPEHRPADGPRQPRQIHLALFRRSQRPALPVRLRPQLHRVQSLAPAPVQRTAGPRRYPGSAGHAQQQRQARRRHGGPALSAGPGRQPQPSGEGTARVPQGDAGARRIAGDRLPPRRGRPEVLRQPAQAHGRAGRVQGLRRPGFGANRKPQLHPALKAPTAPPASPPRANGSVSALGPEPTPGPGAAPGSLNRRPLPPRRSAPRSPSMRPATPPTGCRAKRR

SEQ ID NO: 30418 - protein, 78 aa, Pseudomonas aeruginosa
ISAPCLVLCELRKNAETAFEGPGLLLQELEALRAGASGQFPATLRQRRLQTLPERCGMRAVSDRQSRFQGCHHGAPPL

SEQ ID NO: 30419 - protein, 150 aa, Pseudomonas aeruginosa
FSPARSRTPAATSGRRTTASKRRPAQPAAPVRHPRPLLAPGWRSPHDWRPPGAAGWLRTAASAPPPCRSRKPRPAPPGAPPADSRHTSRPACRAPGHPRRRPPRRAVRRAQALSDSYIRSFLAVTASNMAPARAARASCAGCAAARARAE

SEQ ID NO: 30420 - protein, 427 aa, Pseudomonas aeruginosa
GSTLPEPVRHGRVFVVFAGFAASPPARPPARTSRRRARRRRSSGDRSAPCARQAVGCRPAPGPCRRDAGAAPAYRAWPPPAGTARRMDWPIRCAPAADATSRSRPARRRSARPVRSHGPGPASRARSRCRAGNADAPPGRGRETRESADRRSQHDPAKRLDVDLLGQLLVGQHRQPGIVALHQLAHVAADIHGNDQHRPVLHLREIADGLPHALEEGLGYRRVEGQVAAGAGLADATADLLLHRLVQQIGGKDIVAAGVLVADVALEAAADVLGELHHVLLLLPPLHHRLEDRPHVADRDVLADQALENLGHPLQGNDPLRLLHQLAVTLLHLLQQVARLLDADEILGVLPQHMGQVPGEHLLQAQAGTAGTLQAILMRLLHPARLFSRHLQLCRLVGDREQFQLRGAFAHQQPARPQASARDRDLL

SEQ ID NO: 30421 - protein, 682 aa, Pseudomonas aeruginosa
WRSATPAPARPAIADGQHRVQLQRVGGAQALLRDADGDAAEDVDDDDDQPGDGVALDELHRAVHGAEHLAFLFDHRAPRPRLVDIDHAGTHVAVDAHLLAWHGIQGKARADLGDPLGTLGDHQELHDGDDQEDDDAHHQVAADHEAAEGVDDLPRVGLQQDHPRGAHRQRQAEQRGDQQHRREHRELQRRADVHRHHQQDHGDGDVDGDEDVQQQRWQRQHHHEHHRQQQHHQQDVLALADPAEKPAQVVHSRASSSSARACAARAASRRPASCSARLRQSHRPGSSSPSSCNCRHRRTAGSPRPCWSNARSKARRPSRRSGATLSKASSNTWARRGWPHCRCNQPSISNRRCCVCFNVIDSYLVQQVRGHLQQSLVFIALAEQAGRGLQGRLAGQREGQAEIAQRLAEVAGAQQAVELQLGPGVVEQALLRLLRGIQAGDVGLHRPAVGRQQMALRQGRRERLGMRQVESFDADVPGTDPAHAASTSLRAERSACKAWCNVGMPTCRASRVMHSSRRDSPLQAQRSGRLPAARAWHRAQRPQGAAIGLVPGQVTGQPERQLFAMAFQLQGAAVLEIQLHHARQRRRYAHPQVLAELRDGQLNPVHAAAPLRARSPGRVPSGRHSKDSGAARRRRTLRPATGGRDASVRGKNGSAGRRRPAATARATPAPRRRRPSASRARR

SEQ ID NO: 30422 - protein, 474 aa, Pseudomonas aeruginosa
PRRQPISKNSRLALKFVARGFLYSARRLQPNRSAMPAPLSPLIVRMRHAIEGCRPIQIRGRVTQVTGTLLKAVVPGVRIGELCQLRNPDQSLALLAEVIGFQQHQALLTPLGEMLGVSSNTEVSPTGGMHRVAVGEHLLGQVLDGLGRPFDGSPPAEPAAWYPVYRDAPQPMSRRLIERPLSLGVRAIDGLLTCGEGQRMGIFAAAGGGKSTLLASLVRNAEVDVTVLALVGERGREVREFIESDLGEQGLRRSVLVVATSDRPAMERAKAGFVATSIAEYFRDQGRRVLLLMDSLTRFARAQREIGLAAGEPPTRRGYPPSVFAALPRLMERAGQSERGSITALYTVLVEGDDMSEPVADETRSILDGHIVLSRKLAAANHYPAIDVLHSVSRVMNQIVDDDQRHAAGRLREWLAKYEEVELLLKIGEYQKGQDSEADQAIEKIAAIRQWLRQGTHETSDYAQACAQLRSLCA

SEQ ID NO: 30423 - protein, 247 aa, Pseudomonas aeruginosa
DCCGKRKPAWNRTAPRPRSASKGSASACGSAGENCWNASGNWRSSPNWSATSTPSARGCANAARKANWKNSPATRPGHAQAERRGYGSARVVRHPCPPSAAARAADRLRTGPARAPTAGAQATVRQGRRNDRGRRARRDSRRADLDASRRPARGACRRPAADHSASPRASCRGRNANANANANANANANANANSVAVRIGSTASAGGLRARRGVHASPGAGQRFGASGRRTAAGAGVLPPANRRSDA

SEQ ID NO: 30424 - protein, 191 aa, Pseudomonas aeruginosa
AATARPRLPGENRSRGRVHGAGQCPGFAARADSGRRRPRRGASATRRNRSIRTAPRRPSACATACHANPRRPPGGTPAGIEREPATAAGRSRAPARCRAGAHPGRQRSRKPCGAPAGATAPARRRGGAGPAWPWPVAGRDQCQPRQPGVSPASPWRVARTPATAASGTTGATHLQPAAGQRPALAATSLPA

SEQ ID NO: 30425 - protein, 314 aa, Pseudomonas aeruginosa
RVASRMNGTDLDLPLASRAELDLQRRLARCRRHYAGNALQARLDIAQAAPDVDLELSLAWDGLPLRFLCQAPALAHWLAPNLQEAAFASLPAALQLALLEREGNVFPGLVWYGLSPAQPRAAMGLRLSLERDDQRLALWLDGDPATLLARLPPRPSAQRLAIPLRLSLQWPGLPLDASELRTLEPGDLLLLPAGHRPDAALLGVLEGRPWARCQLHSTQLELLDMHDTPSLADGEDLHELDQLPIPVSFEVGRRTLDLHTLSTLQPGSLLDLDSALDGEVRILANQRCLGIGELVRLQDRLGVRVTRLFGHDEA

SEQ ID NO: 30426 - protein, 361 aa, Pseudomonas aeruginosa
PTAWSSATEADHEQRRHPPLHQPDPVAGAGPVAAAGTGRGPDRHPGIAGPGAHPDPGADPRLRRQAGGRGGGTVRHQRLAGRRAVPFRRNDPAEGAAGAMSVQDLQQLLLTYSLLLPRIISCFVVLPVLAKQTLGGGLVRNGVACSLALFAYPIVAGSLPPALGALDIALLIGKEVLLGLLIGFVATIPFWAMEATGFIIDNQRGAALASTFNPSLGSQTSPTGLLLTQTLITLFFSGGAFLALVGSLFRSYASWPVSSFFPQLGSQWVAFFYAQFSQMLMLCALFAAPLLIAMFLAEFGLALVSRFAPSLNVFILAMPIKSLVASLLLVLYLGILMEHAYDALLLAVDPLRLLRPVLETP

SEQ ID NO: 30427 - protein, 140 aa, Pseudomonas aeruginosa
GCSSAQTQYFQFTLEQKLESFHLTQGIAHARAPSVQPVAADQIPRAVRMRLQPGLHAAGQAGDVLVVVEDRHLDLAFVGGDPGEGLLQFVVLQHQAVAADQAGKHGGIHRVGMQHRADRRVPGIQLGVQEGLRRGFLARF

SEQ ID NO: 30428 - protein, 420 aa, Pseudomonas aeruginosa
GTALVTIRRSPVPHRCLPQPSQLRQDRRVDAHVGVLPTLAQQLVEQDDGHHRLGDRRGADADARVVTALGDHVHRLAGGIDRAPGSGDAGGRLQRQVGDDRLAGGDPAEDAAGIVRQEALRGQFVAVLGAALGDAGEAGADLHALHRVDAHQRMRQFGVQAVEDRLAQARRHAFGNHGDLRPDRILVAAQLVHVGLQLRHLVRVGAEEGILLDAVPAPERNLDRPELAHVAAHLDAQARQVFLGDSPGGHAHGGLARRGTAAAAVVAHAVLVVVGVVGMGRAEQVLDRRVVLGLLVGVADQQADRRAGGLALEHPGKNLHLVGFLALGGVPAGAGLAPVEVALQVPGGQFQPRGAPIDDGDQRRAVAFACGGDGEELAVGVAGHARLRVRTTGKDIGVYPSRTGLRTFPGGRDQSAIIGP

SEQ ID NO: 30429 - protein, 139 aa, Pseudomonas aeruginosa
RPPCRAPSSPCSACSPAWPTPLPTASCTAPTTWTPGTACCAAPCCCRAAPCRRRWSCWSPAPVPPTATATTPSAATTATCCVSPRPWPNAESPACATTSGESPAAWRRRHARKTSASAPMSTTWSPGASGWPATRASPG

SEQ ID NO: 30430 - protein, 161 aa, Pseudomonas aeruginosa
RYPTGRRRSREETAAPLGRTGPGAFPPAPPGATAHRPRDRRPPPALRPARQGRTAQRGPEPAAPEHPGARPDAAQGAEPAGGLGRSSQQGSAFRFGRRAQPGTLEPRAGPFPAGPGDRLGATTLGPLQGGRRRTGAEGWPDRRRTPAPRPFHPRPGLRRQL

SEQ ID NO: 30431 - protein, 254 aa, Pseudomonas aeruginosa
RNCSSQRTKGRHSSRSRRSWPPAREVHTTLVRMRQRFTGSPIGARMKGMCLLRSSDMPHPLTLLQISGRGYPPAPLRQSTLLIIDAQEEYRSGALRLPGLDAAAAEIGVLVQAARASGTPIVHVRHLGIQGGLFDPQGPRGQFLPELQPEAGEKVVEKRLPNAFSGTELHDLLQNHGRLDLIVCGFMTHSSVSTTVRAAKDYGYRCTLADSACATRDIPTLNGGVLSAADLQRAEIAALGDNFAAIVAQARELL

SEQ ID NO: 30432 - protein, 134 aa, Pseudomonas aeruginosa
PCRRDRPAGSARRPARAAWNAAWRTARRCARRGSPAAGRPGARRRPSVPTRQPCAPRSRHGGRPCPRRSRRTAPPAPRRGRPAPGSRAGPGCRRRGSAPDCRACTPARRAGATDRPIRVAAALRSAVRVAIDRP

SEQ ID NO: 30433 - protein, 273 aa, Pseudomonas aeruginosa
WASASRPAPTTSCSPRSARCSTTRTCAPRTSSATCSSARRCTASTTSATATSATTATSRSGTCCSAPTRTPAASTSRRASPATRSSSSSTCCCSATCTASPEKPSPPPSWSSPTSGERHDSRHRFPSQPEHIEIHLVWPPPRRSGPRPYLCATGNAPRRTETQVSGAAHLPRRARAAVQQLPVLPDPPVAPPGIRLQAAPGQLGGHQHPPIQEQGTHPVPDHPAPGRCGQRQERAGAQASGHPAARPPRSRHRALAGRRQRHAAQRAGPARPG

SEQ ID NO: 30434 - protein, 427 aa, Pseudomonas aeruginosa
TVQDPILQVRIRHRRAPYLQGPALPAVLDLGHRQVAERPPAATAERHPAQALAALPAHQLGLRGVLPRGDLRPATARLAAATVAEVPVGRADHVPGGQPPAWLPPYLPLHHPWRQPGEQGAGPLHLQVDPVDPDPAHPARRVREAARERTPQRAHLQYRARRRPGLHETARLLQGHVRERLLDPPGARALPSGADPRAPEVPFRRQLRLRPAPRARQPGALLGCAARPGVRQRLPGGVRAVLPVPDLHPHPVLVVDPARLRAPLVRPQRARPAALPALRLAELGTLPRPPLPGRQAGPGLRPGVRSLEPGRAADRHPAAGVLLHAGPAQPRLPPSQAGSELLAHRAGARGQRGAPLEVRPDDRDLGHVGELPDPARPPLPRPVGPVRNRRLVPREPCPARSGDRCRQPAPHQPTRIPGYRLITQETP

SEQ ID NO: 30435 - protein, 841 aa, Pseudomonas aeruginosa
PPASASRWCSSSVAMRTGTGGSIDPSAWRLEAMSKNARYAWRLSLGGLLLGLLACAVYLLAVPLGFKYGEIQVGHGLEHEGRIAWDAAGVPHIRAQSLEDGYFLLGYSHARDRLWQMEFARRYAGGTLSEVFGVKTLPMDRFARTLGFRRTAEGIYANLDAPTRVLLQRYSDGINAYLELAPAALPLEFSLVRHERPGPWGPVDSLSLHLLYSWTLSANLGMQLQRLALAEHLDLARINEVFAPYPGERPPATRDYASLYRSLRGTPDAGKLLGQLPGSNVEGIGSNNWVVSANRSATGKPLLANDPHLRLTNPAAFYLASMKIPGLSLTGANFAGAPLFVIGHNQRIAWGYTNTGLHIQDAYLERVDPQDPRRYLTPDGYRPFETRLERIAVRDGETVSLEVRSTRHGPVISDIYEPARLPQAQRDRLVIALAWTGLDRHDKTFPSLLAINRAEGWEQFLDAAADFGVPPQNMVYADVEGNIGYVSAGRVPLRGADDDLHGLAPSPGWESRYDWVGYVPESAKPRSLNPREGFIATANQRIVPPDNAFDFGHDWVLPYRYERIREWLGGPGQRTLEDSLELQNDEFSSVMASLLPKMLEQVSDPELRASEAFALLQGWNHQAAADLAAPLIAGYWVRAFTRELLQPRIGTQLLASGWNQRNYDGFLRLILDGQADLRFWCGQEQGCDLKLNQSLRRALDELRAAHGSAPSGWKWGEAHAALAEHVPFHKTPLRALFDLKNNKGGDNFSVNVGRLDYSDPANPFNTRIAATLRMVIDLADFDNSRYALSTRNSGLPFDGATDLNELWARGAYIRIADDAPDATDRQLVLRPSAPSSGEPRP

SEQ ID NO: 30436 - protein, 329 aa, Pseudomonas aeruginosa
YPAGNAASPRISSRAWRCPATPGPTTTSSPTSAAATRSSAWSASRPVPNPTCSRGSSGERTRAALRRPVAGGAAGRGALRRLGGLCQPGRRPGRDGRRRPAPGRRESPGDALRPVPVAMSRPPPRPCATPGAPAGGAPADRADGRAALALGHAASIGERGAIVRHRLALLRPLGAPPPGPPANQPRLAGAPARAAPRRRDRPVYSEPSYPPKDAPSPCWRFSERPLRSTCARCSGPAPNWTCPTAAKTGAAASATPTRRNSSPSTRTPWCRCCATANWCSGNPTASSATWPTAMPANASIRSRRRRARGSTSGWTGRPPTSTARGAMPS

SEQ ID NO: 30437 - protein, 153 aa, Pseudomonas aeruginosa
LHHPLGGRLVMRSWTAPPANDSQAPRGAYRSQHWPAGASASSLSAALATPAPRQLEQDMYRDTVTLTVSAEQRGRESEAVDNPNVAIGLESVEPGVLKLHFEGQLDAPENATHICFSLTIGLTYYGPILDGAASENGGWMTFESDMLDPAQLA

SEQ ID NO: 30438 - protein, 326 aa, Pseudomonas aeruginosa
REPDLLGQEGRRRGSRPGWRRRVARPVGTDRSQGQELSGDRRPQLRRRNHPRRTSRPVARTPAGSPGRSADTRLRRRGNHAESGDRGQSGPVAQGEQPQGRRPGSPAAAAAVRHQFPRRQRHPLRLPARPMGRRQPHLEPGGPGQDLQRNPLSPPGRRPGYHRPRQLQPVSDRPADRPRVPAAGWQRQLRAKTARTTGDRRHRYRQMALQELLQRGRRQRRSGAAAHALLQQRAGQLHLHLAVLHRRPQRYLQRPGDRLHGHRRQQGHLRTYGWRLLLPGVPRPGAEELLVRQVLRLPLPQSHGHAPAAATATLGTRHPQRTGRPL

SEQ ID NO: 30439 - protein, 133 aa, Pseudomonas aeruginosa
CARAGLSSANMRSISSIRWYGLSIALPSPSRVRATFSRLNEGKLQVAERSASMPSMIRRPAAAAKKWLLRLPCSRQPISSPPRPRRSGTFRRWACSCRTRRSNCTRFQPMMASGSCSASHWLRRSSSPARLSQ

SEQ ID NO: 30440 - protein, 164 aa, Pseudomonas aeruginosa
RPARAFPWRISMPTSLVLNGKNVTLDVDPNMPLLWAIRESAGLHGTKFGCGMAQCGACTVQLDGTAVRSCVLPVSAVAGKRVTTIEGIQSKPGKAVQDAWVKLQVPQCGYCQSGQIMSATALLEQNASPSDADIDAAMNGNICRCAAYVRIRAAIHEAADTLKA

SEQ ID NO: 30441 - protein, 786 aa, Pseudomonas aeruginosa
RHEQQDRSEQRPARLAPRLPQRRRGGRPDHRLPVERSPACPRRGPAGRRLRAQRLPADRPGRQCHGDRQARGDGPGRLYRYRHHRRRGTRRGLEQGPRGKRARRRQALRQPGLRHHAGHRRQFGDGQLLDAIARGRGQGARDAGRGRRPPVASAGHRTAHPRRLRRTSGQPAQGQLRFAGRCGGGTAGAGKSAIEGSQGLPPDRSPGAARRRSRQDRRQCAIHPRRQPARHAGRPAPAPAAVRRHGEIVRRHGDQGDSGGGRGGPGAARRGGGRQGLLGGEARPRRAQGRVGREQGREAWFRGADGGVPQARRATRQARAQGRRRRQGGGRGDPQDRRQLRVPVPRPCADGAAGRGGQADRRQLRDLGRRPVPDRRPGQRGAHRRAEAGAGEDQYALRRRQLRPARQRLVGLYRRGGIDRQGAGRQRRAGEAAMDPRGRHPRRFLPADVLPPARSRARRRRQAGRLATSHRRPVDPGRHAVRRGDGQGRHRRHLGGRRRQPALCGAQCLGRAEHHPGRRAGPVVAGGRQLAHGLRGGGVHRRGGAGRRQGPLPVPPRPAGRAAAPARRARTGCGKGRLGPVQAAARRARARDRGDRGIQDLRRPGGRGLGGQGRQAEGRAGGLCGGLWHPDQPGRDRRADGGRHRLRPRRDPAQRDHPEGRQGRAEQLRRLPGAADRRDAQGRSAHRALRRSAHRGRRTRCGAHRPGAGQCDLRRHRATPVQPALPHLLRQGLSETPAGSSTAAGAARAALRGSPPTIRVSPVSRRFASARRRAQTSASIRPRSQA

SEQ ID NO: 30442 - protein, 198 aa, Pseudomonas aeruginosa
LRVEARVWVFIAVPASSPVRVSHWCRQRPSARVALTVSRCSKASSSTPFFIAPSRRFCRDRWPSRRWVSSPGRIISTQATSGTQTTWPPITAMISRKIATNGRSLISAALDEVKNSRTDSNSRTWVLKAPIDAGLAATRVLSTRENSRVESCRSRRLPSTLSRWPRMIRRTPSRTIARATPLARIHRVSNAALGTTRS

SEQ ID NO: 30443 - protein, 434 aa, Pseudomonas aeruginosa
RTQQADLRGRPILDALAFDPQVDQLPLCLEPLALHVEQVDHVAPANLELFAIQLADLLRLGHLLGQRLFPPAQRVAVVEEVLQLPADVALHRVGAPFRRLQALLRGGRPAEVGKPLEGVHAEAQGYHRVAFRMPADLPAQRAGLQVQLRQQRRLGLADLGLGDIGVLQGLALQRRFADHPRHIAGRQVALQRHRLGLHQVGGLLADQDRVLVARVLQVALLQRQLLLGPRQFQIGAIQLAAVGVAVAAARLGHLADAVEALDVLAHRLHPALRGKHVEVGLDDIQRRIVARHQHRLGQLALGRAGAVDLARHPTPVVQHLRRGEIVDDLAEVELLRPPGHRHGGVVPPFGHLHLGACTVRFGHRGSYFRVDRQPCPDRLVEGHGRREHRQTQGKEPDGSLPMPPSLARVLPAPAHQTTTCTVLSSISRVVLPKV

SEQ ID NO: 30444 - protein, 1042 aa, Pseudomonas aeruginosa
LFGSAVPVSSAPSALMLSSGADGATESTVVLAGPLALPAASSATALITVPLASGVPGVKVQLPLPSAVVSPIGLPLPSVRITLAPTSAVPVITLPLLALITGVAGATVSTVVLAGPLVLPAGSWATALTTVPLASGVPGVKVQLPLPSARVWPIGLPLPSVRITRTPGSAVPLSLTPLLGSITGVAGATASTVVLTGPLVLPAASWATALITVPLVSGVPGVKLQLPLPSAVACRIGLPPPSVRITVAPASAVPLITVPLLGSSTGVAGATESTVVLAGPLVLPAASWASALITEPLASGVPGVKLQLPLPSAVTWPIGLPPPSVRITVAPASAVPAITLPLLGLTTGVAGATASTVVLVGPLVLPAGSWATALITVPLASGVPGVKLQLPLPSAVAWPIGLPPPSVRITVAPASAVPAITLPLLGSITGAAGATESTVVLAGPLVLPAASWATALTTVPLDSGVPGVKLQLPLPSAVTWPIGLPLPSVRITVAPASAVPAITLPLLGSITGAAGASESTVALVGLLLLPAASWASALITVPLANGVAGVKAHLPLPSAVTWPIGLPLPSVRITVAPASAVPLMTTPLLGLITGAGGAMASTVTLAGPLVLPAGSWATALITVPLASGVPGVNVQLPLPSAVAWPIGLPPPSVRITVAPASAVPLISVPLLGSITGAAGATPSTVITAGALSTLLGLRATTLTTVPSGSGMPGVKDQLPLPSAVTWPIGLPLPSVMMMVLPASAVPLITEPLLGSTCGIDGSEESTVVVAGALVLPAASLAVTLTTVPLGSCEPGVKLQLPLPSAVVWPIGLPLPSVKVTVLPGSAVPLSRLPLLGLTTGVFGATASTVVLPCGPVLPAGSWATALTTVPLASGVAGVKVQLPLPSAVVSPIGLPLPSVRITLAPASAVPLMVVPLLGSITGAGGATASTVVAACGPVLPVGSVAVATITVPLAGGVPGVKLQLPLPSAVTCPIGLPPASVRVTVAPASAVPLMTTPLLGLITGAGGALESTVTVAGGLLLPAASSATTLTTVPLAIGVDGV

SEQ ID NO: 30445 - protein, 245 aa, Pseudomonas aeruginosa
VQLPLPSAVTSAIGLPLPSVRITVLPGSAVPLRLLPLLRLTVGVAGAMASTVVLPWPPVLPAGSVAVALTTVPSASGVDGVKLQLPLPSAVTCPIGLPLPSVRVTVAPGSAVPLMTTPLLGLTTGAAGATESTVVLAGALVLPVGSLAVALTTVPLASGVPGVKLQLPLPSAVTWPIGLPLPSVRLTVAPGSAVPLSVVPLLGLTTGAAGACESTVTLAPGLLLPAASWATTLTTVPLAIGVDGV

SEQ ID NO: 30446 - protein, 772 aa, Pseudomonas aeruginosa
VQLPLPSAVTSAIGLPLPSVRITVLPGSAVPLRLLPLLRLTVGVVGATPSTVVLPWPLVLPAGSVAVALTTVPSASGVDGVKLQLPLPSAVTWPIGLPLPSVRVTLLPGSAVPLSVVPLLGLITGVAGATESTVTLLPALVLPEASVAVALTTVPLGNGVVGVKLQLPLPSAVTCPMGLPLPSARVTVAPGSAVPLSVVPLLGLTTGVAGATGSTVTLAGELALPDGSVAVALTTVPLGNGVLGVKVQLPLPSAVTWPIGLPLPSVRVTVAPGSAVPLRVVPLLGSTVGVAGATASTVTLAGGLLLPAASLATTLTTVPSGSGVDGVKDQLPLASAVVWPIGLPLPSVRVTLLPGSAVPLSSLPLLGSTTGAFGATPSTVMEVAGLLLPAASLATTLTTVPSGSWLPGVKLQLPLASALVWPIGLPLPSVITMVTPASAVPLRTLPLLALTWGASGKSGASAVTGVLLLPAGSVTITVTVSPLVSGGFSGTSNLPPGPTTTVVSGWPSPSVSTPTVAPGSALPVTLLPSGATCTSVAGAGAVVSGASTVTGVLLLPAGSVTITVTVSPLVSGGFSGTSKLPPGPTTTVVSGWPSPSVSTPTVEPGSALPVTLLPSGATCTSVAGAGAVVSGAVTWAGGLALPAGSVTTTVTVWPLVSGGFSGAVKLPLASAITVRSGLPSPLVSMPTLAPASAWPLMLLPSGAIFRPLAAFGGVVSGGTEEPPPPPPPLLLEIATPAPMAAAPTSSAVPALMPPSTPAPVSDSKPARLSCGM

SEQ ID NO: 30447 - protein, 287 aa, Pseudomonas aeruginosa
FVGARRRQDDPDSSNGKHRRASREAAFIVLQSKRHRHDAKLSNRSSPASDHASRYLPAPGRRPVRPDLRFPFPPRRSGAGNRLGYRPRLPAAGSRGGAGRVPLAAPEPRPCRLRALDEEASGTAGLFLRKPARGVALDAHRTRRLGAAGSGQRRGLQLRPGLFGRRHPVGLRPWPAAGQCTSATAALGGQAALFGEARRTFPFAPAVADPPVARPGRRADPDRPRNQRRSGPHRGPATGPAPLRQPRRPRRHAARAGTPATPAGAGARFAAAPAQPTAGMATGCRPA

SEQ ID NO: 30448 - protein, 217 aa, Pseudomonas aeruginosa
PAGRCSPGSGPYGSSWSPSRWGGSPVPGSATAPVPYRRGRRPRCRSHCPSAASRRTHRRTSTDSPSRCSNALRWAARNSPGARAIASGWMAAPARPSPGVAGPRGCAAAGVPRPGCRTGAGRSARRRRADCRLARRRPSPPLATDRAARPMPRSGRPRRRPCAQPPGATGIPRNRSSAATTAATRRGPGHRSRVSPTAVPAAPPRRARPAPPTARIA

SEQ ID NO: 30449 - protein, 142 aa, Pseudomonas aeruginosa
RPWLMRSRPAASRTMLGRRKTIRLRFTRVSRDERNSRPTPGMSPSSGTRESLRCRSSWINPPRTMTWPSSASTVLLIERLLVTRSTAFAARVAVGAMEDISCSISRRSMRSSPMCGVTLRVTPISLRSTVVNGLLEPLALVV

SEQ ID NO: 30450 - protein, 259 aa, Pseudomonas aeruginosa
LPVWNGTFWPTRISAFWLSRVSRLGVDSRLLRLLRLSAVTSAPKSRLPRPTIAPSGSSAGGLPACNAPSRVPMDNPLSAKPAPPATCPLRSAHCTPRASPISPDSSTIAASTSSCARGTSSWRTMSSSRPTSSGSARITRAFSDSSARTSRPRLPLPRPSWPRSPCSDSPISPRVAARVLASPWRMRITRLFADRDEGTSSDCASRSKRARACGGPSRTRRLLRLSARTWTVAALFPAAGVTLRSSTSAISATQAWRMS

SEQ ID NO: 30451 - protein, 522 aa, Pseudomonas aeruginosa
PSPNRRCMRRRICSFTGFTWGNPREAMKAPIRRSPGRSMPSPKAPPSTAKPMPSPARDEALEEDPALRLVHPWRLAPARHPRVCLAEDVQRLLQVIEAAEEGQVVARPLAKLLAENRCDGRQGCLALRIARGNPTLYVHLQLLGAEWRVHFQPGRARRQAEQVGVIVARPKGSGEQHGGAAGGEALGEKRRRHHVAQAQPGQAAAVAAWALLDVEQRMLAEQLGETAELQDREVELLQRRLQRLRLLGEQVVDRRHRVLQGQEQLLRRLVVGLVVVRLGLGQFVPGTLDALQRFPQGLRGGFAHTEEIALVEFGGIHPPAALHQVVRLVHQYRHPPLVDLGQAMEHGAEIEVVVVVAHRQVAPARQFLAQVVGTDPVRQRHLAQPRLVQPARLHGGGAGRRQAFVEALGQGTGLAVAGLVRVLAGLVPRHQFQHPHRQSAGLPFQATQGMQREGPARGLGGQEEQPVQALPGHRLELREQRADGLADPGRRLGHQATTGGGGLVHRLRQLPLAVAEFGVGKA

SEQ ID NO: 30452 - protein, 132 aa, Pseudomonas aeruginosa
PRPSGSAAAPARTGSGPAGRRGCPGYPPAGVRTRRAGGPPVGNRAPVRAVPRQAVPSRRRATAGRTCRGSDSGSRRGSCRPPAVPGRPRTGRRGAGGSRRCAGPPARCGRDGRTPQERRRRSPPSRAVRTAN

SEQ ID NO: 30453 - protein, 130 aa, Pseudomonas aeruginosa
SGRSRRSAPRNRALPGARGPPTRRYRVRSGTPGTGPGGRFPEPPPAPVAAGRACLAGAAAIGPGPGVRRRFPAHSWPPAPMHGLRRSARRVPGCESPAGARRGGWIGDRAAGPGRNPAAFRSAGRTGTAA

SEQ ID NO: 30454 - protein, 134 aa, Pseudomonas aeruginosa
PAALPARDWRRVRPAGRRAVPPAARRGRSAGGNRTGGDRRRRRRAGESRGSRRKTRRFRNDRYPGRQGQTPTSPATGCRNTSTASGRRAPCSATRRPVRRSRPATRRAAAPRGTTAGAVPAAHPCAGSRARDGP

SEQ ID NO: 30455 - protein, 146 aa, Pseudomonas aeruginosa
SSTPPAKSSPTAASAPPGSATSPSAPAWRRPTCSITTAPRRNSTRRCWTASSSPCWKPPGHSPATSRPPRRYAPTSTTRCASAPSGRTRPGSSPARSCAARRACRRRCWNASTPRRNATPSASASGSTKACWRRWIRTTCCSTCGR

SEQ ID NO: 30456 - protein, 111 aa, Pseudomonas aeruginosa
RVAASGTCPSPTRRPRPTASPPPRRWTSSASPPRSGRSWWKARTSARPTSSFPAATPNWASSPCRRSTRMVKSQPARPGSFPPSCTTRSARTRSSSTRARTTPPPRPWSTT

SEQ ID NO: 30457 - protein, 419 aa, Pseudomonas aeruginosa
SAATSRRKPAWSRCRYSITSKPWNTPRPTAWPAAWWRSPSSSSSPSIRAGAAGRAGPEMDGLRLRFRRAYPGFELDIDLALPGRGVTALFGHSGSGKSTCLRCIAGLEKAAEGEVTINGETWQDSRRNLFVAPHRRALGYVFQDANLFRHLTVRRNLAFGLKRIAAAERRVELEQACALLGIEHLLERMPERLSGGEQQRVGIARALLTSPRLLLMDEPLASLDLKRKGEILPYLEHLHEELDIPVLYVSHSPDEVARLADHLVLLENGKVRASGPIGETLARVDLPLALDDDAGVVIEGTVSDHDPAYGLLTLVLPGSALQMRVAHAPLAPGKRLRFKVQARDVSLNLRDDAQSSILNRLPVRVLELVDTDTAAHVLVRLDAGGNPLLARITRYSRDQLQLRPGQLLWAQIKSVAVLA

SEQ ID NO: 30458 - protein, 602 aa, Pseudomonas aeruginosa
TAKLRQCSRQRFHQRRRGTDGTDRLGRQPDPLAPRAQARHHPAQPHHPAHGADRGRPLLPRPGTADPAADGGARGTPGPAPAEPRRAPADQRRLALHAARGGAAHRRVPPAVPGHPARTQHQRPDHRPVGATHRRGDPHRCAQRLHPARAPAGRQPPAHPRQPGVPGPPRHAGEHRGAARAHPARLHPARAPQPLAGGARRRRSPGDPAGYLCLQRRDAPPTGPEPPGHRLPGQLHDRPRYPGRAPGAAVRRTDERIPATDPRRLLSQLATGAAHPVLPRLHPAAPGRLRPTVNESLDFSPYLERWALQPDGEPFATHSSRLLPVRHRGAAAMLKISSAEEERFGHVLLNWWDGQGAARVLAYDHQALLMERATGGRSLLEMVRRGDDDEATRILCQAIERIHAPRPGPLPELTPLERWFDSLYAAERRYGGLYVDCANAARYLLETAREQRPLHGDIHHGNVLDFGERGWQVIDPKRLYGERGYDYANLFTNPDAKTAQAPGRFERQLEIVIAASGLQRRRLLQWILAWTGLSAAWFDEDGSREETEAELAIARLALANLARTPAPMNCAAAPALQREALFRRRDPVSNTHPAKMAVPTTQ

SEQ ID NO: 30459 - protein, 216 aa, Pseudomonas aeruginosa
NGHQCHEPFVPSLPDEDPTSALHRPGNGIPRKIPITQRGPEGRACSPAGRTPGPGVPATMNDTDSRKDPDGYNYDVVRQFTLMTLVWGILGMGLGVFIAAQLVWPALNLDLPWTSFGRIRPIHTSLVIFAFGGSALFATSFYVVQRTSGVRLISDALARFVFWGWQAAIVGMIVSYPWAIPPPRNTPRWNGRWRCGWRSSGWSMHTCSSAPSPFAR

SEQ ID NO: 30460 - protein, 114 aa, Pseudomonas aeruginosa
PNTVEPGSATHVPHRHERERPTPMNATLRFNEALLITGRAFQPYQCVAWSELGSDGGLSLSVVDRTGTRLLGRARIPSSAYSDPEQLAGLLQQAREELSHNGYNLQDWSMPSQG

SEQ ID NO: 30461 - protein, 409 aa, Pseudomonas aeruginosa
PVTPPPADASSGPAVVRSDAMLLRNPTLLLLFCGQALYWSCSLIGITLTALVGVQLAPLNSLATLPLALLVLGNLLAVQPLSHFMQRHGRRPGLMLGAGGGVLGGLVCAAGVWTGDFLWFCLGALGIGVYQASAMYYRFAALEAVDAGRKGRASAYVLAGGVLAALLAPSLALWSRNALAQPFVGAYLLIAVLALAGLLLMALLREGQAPRPARLAWRDIGGLLRRPVVRAAIACTAAGHGLMILIMNATPLAMSFCGLPLEQSSRVIQWHVLGMFLPAFFAGPLVDRIGNRRVALLGAFLLAASAGIALDGQSVTHFLLSSLALGSGWNLMLIAGTTLLGEGHAESERGAAQGLMEQGNSLVAALMSFGSGALITSLGWNAVNLLVWPALLVALTLLWPVRRTRTLSR

SEQ ID NO: 30462 - protein, 998 aa, Pseudomonas aeruginosa
PTRPLWSGSRDSEVLVAVHVQCARLDRLGFADVRLEIVEVAPELRIAAAHAPAFDHLVEVLAALRRLQGADEGLGIRRRQIEHEVRVAGQHARVDRQGVQARLVAQRLAEHEGDIAVRAVAQHGIDLALAAGRTYPQHGRLGEALDDLEAGRRPAHQATEGLLGVLQFAVDARSIAVAVQAAVDRVGTRIEVAVATQQFFGEGLLRLLLRQSQRARRVIVEGLVVHPHLQLAAVLVPVVEQRLARVDRHQAEEVLLGAVADQVEVQPRLRLVRDVAEDIEVHHQPVVGSLEQRVVHQPQGLRYLAKQALAHRGAVELAEDAQQGVVVAVPERVPGRRRRVGVDVLAQVFVLVALVPVGAPQAEQVLQLVDLPRQGQQRLALRAEVGVGDEQVLLGVLEYHPEVVADHVGGDLSTAHRPADEGTGEVFGVIQHELVARPWRDRGEGGERVGAALHAVAGNLVGVPLGAEEQLLDAFQLLRRQRIGDVRLVYDHALDRPEAVIEAVARIVVGTPGRDRVDRLAAGRARTHQLEEVAGRALLREIQVRQEQVLVEPARDQALLGPRLVEETLPAGHLARLGGGRPQRLLVDRGARGQPLLQGGVFVVAQPGHRERHAGTWVLADERIDAGRRRALVGAVDRNVQAFGDLRIRLQRLAVAKLEHPRHQCGLAILRFEHRPEVLAPPGVGTVRIEVQAGGFLRLGPRAVVDRQLVGAALRALGAAQVELAGRIVAGVAGDALGGKDRLDVTAIGNFSSGNRLDKRRQNEGQPNQRSWQHEPLLTRRRAILANPPLCAALSQRRANSPRARAAISPAFHRLRPPRMLAGLPGPPWRSRTMTSRKQGYVSTRRAPSAPVRVRPTSPLRRFPPAVVRRRFRSRPARPGPSFRRPGGPTENPPHETARRQLRRSLPEPFGPGGGLYFHPAGNRAPVRLAEHVRRRGRARPRDVQQRGSQRRQPRCLSRTAGLPGRPRQRQRLPHRGRRHLVARRRVPEPGRPARADA

SEQ ID NO: 30463 - protein, 155 aa, Pseudomonas aeruginosa
YMDSLDQCIVNACKNSWDKSYLAGTPNKDNCSGFVQSVAAELGVPMPRGNANAMVDGLEQSWTKLASGAEAAQKAAQGFLVIAGLKGRTYGHVAVVISGPLYRQKYPMCWCGSIAGAVGQSQGLKSVGQVWNRTDRDRLNYYVYSLASCSLPRAS

SEQ ID NO: 30464 - protein, 782 aa, Pseudomonas aeruginosa
TSFNLNEIHGPTTPGRKAPAFVMLFTFPPTDARSIHVQPAHRSQRPPASPPARPQGTYPDPRWRHGHHDPELQAGRGRLPRRALRRLAERRERQQRPLAAEPPGRDPGHREGLPRRRRRHPRDQHLQRHPGVPGRLRHAVAGLRTQPRRGAPGPPGGGREDRRDPGQAALRRRRARPDQPHLLDFPGREQPRLPQRHLRRTGGELRRGDPRPDRRRRRPDPDRDHLRHPQRQGGDLRRPGRVRGTRRGAADHDLRNHHRRLRPHPVGPDHRGLLELGAACPADLGRPELRPRRQGIAAVHRGTVDQGRHSCLGPPQRRPAERLRRIRRIAGGNGRGGRGIRRRRLPQYRRRLLRHHPGAHRGDRQGSGQVPAAGHPGDSPGLSPVRPGAVHHRPQLAVRQRRRAHQHHRFGQVRPADPRGKLRGSSRGRPAAGGSRRPGDRHQHGRRHAGLEGGHGHLPQPDRLRARHLARADHDRLLQVGSDRGRPEVHPGQGHRQLDLDEGRRRGLQAPCPPVQALRRRGGGDGLRRGRPGRHPGAQGRNLQALLRHPGRRSRLPTGRHHLRCEHLRHRHRHRGTQQLRGRFHQRLRLHPRPPALRPELGRGVQRVLLVPRQQPGARGDPLGVPLLRDPQRPDHGHRQRRPAGNLRRDSESAARPGRGRGAQPHARGHRGPAGDRRRLQGRRRGQGGRGRGMAQLQCREAPRACAGQGHHHLDRRGHRGMPPAVCASHRGHRRSADVRDERGRRPVRRRQDVPPAGGQVRASDETGGGPPDSLHRGGERR

SEQ ID NO: 30465 - protein, 451 aa, Pseudomonas aeruginosa
RGRPRRDGAGGEDPADRHRREMRHHRPVWPDHAVAGRDGPRRQGNAAAEFPVAADDRRRHYLEGAYRGEDRSAVQQRRGGLRHRRLARGRRGHQPAVQGAEGRLRGPHPRRLRGGPRTHGQPQRPHRAAELRTGDRQQAGVRLGRLPGADAFLHRRQGARRDRPRGARRVHRLDAVLHFLGPGRQVPAHPHRRSGRRGRHLVVQRRPGDAEEADRREADQGPRGVRLLAGQPGRARRPGGLRRRWRDPRHPAPPAAADDQAGRQAEPVAGRFRRAEGKRRARLHRRLHHHRRDRRRGSGQGVRSQGRRLQQHHGQGARRPPRRSLRRVAARAGAQGVLGLRPRRAPRQRGLDQGAIRRHPPGTGLPGLPRPYRERHPVRTARSAGPVRRQPDRALRDVPRRGGQRLVFRPPAGAVLRGRQDRQGPGGTLQPAQGPGSQRQRALAGAEPWLR

SEQ ID NO: 30466 - protein, 126 aa, Pseudomonas aeruginosa
LTRKATMKFLTPEQMEKPRKRRLRKKLRLGEFQEFGFSFELTYDRSALSHDDALDHLIDFVEAQGWVFGGGGSPEQAEISGYLCLARVGSLDEADRESARLWLEAQPWCKTFEVGPLSDCWHNFFE

SEQ ID NO: 30467 - protein, 387 aa, Pseudomonas aeruginosa
PRPPPAPRRSRRQAPALREDRPRLAAGPRPRCLHRPPAGRGLPAAGRTPWSAPGSSGTGRHRPPAQRASGERRLVAPAGGTGRPADGGKRAAAARWAVRLDPGRLRGRLRVLHDRPQRPAAPGRQPGDGRPGGPGAAPASGEESGVHGHGRAGAQPRQRPRSHRPARHRWRHRPQEPGVLHRRRPPRVRAPAPATGEARPRPVPAQHPRRTAPATVAQGAAAEPGRTGGSRRGLRPPGRLSDPVPMDPARRDQRQPGGNGRHPAPAQGPLRGDEPDPLQQHGRRRLPAPERGADRRAGALPAQPRRADQGAQLGRPGHRRRLRATARQGHAGHGGTTHPRPPGLKPPSSRQGSRLSGQVWKREDHRWVSRRKNRTRSRRPSGRCCIA

SEQ ID NO: 30468 - protein, 184 aa, Pseudomonas aeruginosa
GVPPAAPAERSLYPALCPDAAHRRSLWPALLAPTAQAGADRPRLRQGLRPHQHPAERAVQLAGAGRRAGNPRRAGHRADARDSDQRQLHPQHHHRPVRRRRPRRAGGPAPLVRDHPPMVDLPPRVRPPAAQVQDRGERRGERPCRHRSARHRPGGGEERGRRARLPRLGRRRPGPNPHRRQLHQ

SEQ ID NO: 30469 - protein, 156 aa, Pseudomonas aeruginosa
IPALAAPARLPGCHPARLQPLWPARQQVQGADQNPGQGADPGSLRRARRGRMGQPQGRTEHPHRGGSPARRRAFRRSGLQGPRRPRRVPRPARRGAPRLRPLARTQHLRPQEARLRRCDALAEAHRHRAGRRHRQTAGGHRRSRRPLQLRRGAQQP

SEQ ID NO: 30470 - protein, 204 aa, Pseudomonas aeruginosa
SEHHSRRRRAGRTLRPLGRTPRTGLRHPQRRPADRHHLLPRRRLLLPGQRQVDPDRRSHPAPLRQSRLSIRHRRHRPEHLRLHERLRPSPCRPHRHPRGRQERRGVLPGLPRRQLGARRQPRADPRPVLRPGADGRRDRQDHPGLRGTPDRGRTLHRHLPPYRYRPVQGARICSESLRTARWSTTAGTCCPRTRPWKAYPTATT

SEQ ID NO: 30471 - protein, 307 aa, Pseudomonas aeruginosa
TSPPLPMAAASAARACCASATATRARSARSATCCATSCSSCAAAASTPTPSVPTAARKTPWPAWTTSARSTRPRWSSRYRCSAAAADPRPDEKAPQPRGFFIPEVTDASGRPHAVPGHLRQQFATVGQRHPGSPGQPLAGKIVGRADHHRSKAVVRHLAEQALGPISRQRRMDPCEVRLVVGPQALAQLPRLHPPAAVQDEACPVGIRHDPVDVAGDQQPDRFLGAARPGEAGFEQRRVLADPGQVQFAMDAFLVAEMVVEATDARSGTVADHLDGGGVYAMLAEAGQGGLENLVFAGRTAHVGPCR

SEQ ID NO: 30472 - protein, 377 aa, Pseudomonas aeruginosa
PSSTWPRPLATCARWPTAARSTGKPPATWWCRWSPMSTTSRYSAPRSPCTSARPDRQGAPAVLSAGWRRPGGQLYSRSHEQTTETGMNPPQPRLIDNGNGHPLASHWYRPAGEPRGYLLIVPAMGVEQRFYAPFAAWLAERGYLAITFDYLGMGQSRNGSLRGLEVDVLGWARHDCSAMLAAALAESGSKPLYWIGHSLGGQILPFVEGRERIDRVFSIASGSGYWKENSPRLRNKVWLFWYLVAPLLTPLLGYFPGRRLGMVGDLPRGVIEQWRRWCLHPQYALADGEAIRRAFSAVRTPIVSLSFTDDEMMSRRSIESLLGFYREAPKTAWRIAPEEIGARHIGHFGFFRPQFAESLWAGYLLPELGSGNALSRG

SEQ ID NO: 30473 - protein, 387 aa, Pseudomonas aeruginosa
ISQLSPVTIIAQPDARTGSRGSAVAPREGNPMSLTDQSTRIRAGEELDAAVIDPYLKAHIPGLEGTPKISQFPGGASNLTYLIEYPRQEFVLRRPPFGHKAKSAHDMGREYRILNQLNAGFPYCPKAYLYCTDESVIGAEFYVMERVKGIILRAELPPELNLDEQQTRSLCKSFIDKFVELHNVDYAACGLADLGRPDGYVQRQIAGWTDRYEKALTPDAPLWEPVKAWLKDKQPADHHKPGIVHNDYRFDNVILDPENPMQIIGVLDWELATLGDPLMDLGNTLAYWVEAGDPAPVQLTRRQPSHLPGMLTRREFADYYAERAGIPPIDNLDFYYTYGLFRLAGIVQQIYYRYYHGQTQDKRFAQFVQMNKLLEQMSLQAIERSRL

SEQ ID NO: 30474 - protein, 256 aa, Pseudomonas aeruginosa
PMSKTHLFDLDGKIAFVSGASRGIGEAIAKLLAQQGAHVIVSSRKIDGCQAVADAITAEGGKATAIACHIGEMEQIQNVFAQIREQFGRLDILVNNAATNPQFCNVLETDLGAFQKTVDVNIRGYYFMSIEGGKLMKEHGGGSIINVASINGVSPGEFQGIYSVTKAAVISMTKVFAKECAQFGIRCNALLPGLTDTKFASALVKNDAIRNLALQRIPLKRVAEPSEMAGAVLYLASEASSYTTGVALNVDGGFLS

SEQ ID NO: 30475 - protein, 344 aa, Pseudomonas aeruginosa
RASSVMDGTPRLARASVRMDFRRIRRDISNTVFLNSPYPGDIAMADLRQFRQFVAVAEELSFRRAAERLHMAQPPLTTAIRRLEEEVGASLLERDNRIHRLTPAGRAFLDEARRTLAQAERTLAAARSAASGRRTLRLAFVDSTINILLPRILQAFRHQHGALDFQLQEDTTAGQLEALREDRIDAGLIVLPVDCQPGLYTHLLVDGDMRVALPEGHRLARHARLRLEQLAGEPWLLFPRHYGPGMHDLIVAACAAAGFVPEVVQEARQMQTIAGLVAGGIGVALVPSLLQPLRPPGVTFRPLQGRRARIPYRLALAYRTPSELIERFRETAQAIAAAPAFRMA

SEQ ID NO: 30476 - protein, 285 aa, Pseudomonas aeruginosa
NCGHYAHPSSRRPARPFPDWKQVRFFMPFELAIDPSTLIILAVVAFLAGFIDAIAGGGGLLTIPALLTAGVPPHLALGTNKLSSTFGAATASYTFYRRKLFHPGKWRNGLLATAIGAAIGAWAAHLLPAEWLNRMLPVVVFTCGLYMLFGGTPKAPLDADAPLGRKRQWPQGLALGFYDGVAGPGTGAFWTVSSLLMYPLDLVRASGVARSMNFVSNIVALAVFVASGQVIWLLGLCMGASLMVGAYFGARTAIGGGAKFIRPVFILVVLALTARLAWQHWFSGA

SEQ ID NO: 30477 - protein, 282 aa, Pseudomonas aeruginosa
RRQGIEGEPLGVLDLVLLRDDLAGHVLGVETEHQRMRERPVLAADVFEIGDLHPDLFAHLADHALLHRLAGLDEAGQGTVYPRHEARRTRQQHLVAPGHQDDHARRQARVLVQPALRTLHHPLVVLRLHACAAIAAEPVVTCPDADLAGIAEHAELIEIAVQHELPQRRPGHARQLDRLVQFQHVDRLALPMADPMFGEQREFLALQPFAGEQQAVVVLEEALLTVREHPAADLGGSRPTCLPAELAGHQAATGSPSALTLALARSRTSGWPCGRSTAPPSR

SEQ ID NO: 30478 - protein, 518 aa, Pseudomonas aeruginosa
SNESPAGIFSLFLAVESIVSSPLSQAFAQNFLGHSPRWYKLTVLAFLLLNPLLLWLAGPVTSAWVLVGEFIFTLAMALKCYPLQPGGLLVLEALLLGLATPEALYAELQHNFPVLLLLMFMVAGIYFMKDLLLLLFSRLLLGVRSKTLLSLLFCLLAALLSAFLDALTVTAVVISVAVAFFAVYHRVASGQRASEDYDPATDRQVPELHRAHLEEFRAFLRSLLMHAAVGTALGGVCTLVGEPQNLLIGHEAGWHFVEFFRQVAPVSMPVLAAGLLTCVLLEKSRRFGYGAQLPAAVRQVLAEYAASESRKRGAQQKAALLVQALAALVLIVGLALHVAEVGLIGLLVIVLITAFTGVTDEHQIGRAFQEALPFTALLVVFFAVVAVIHQQHLFTPIIQAVLALPTERQPGMLFIANGLLSAISDNVFVATIYITEVKQALDAGHMSREHFDTLAVAINTGTNLPSVATPNGQAAFLFLLTSSIAPLVRLSYGRMVWMALPYTLVMGGLGWWAVSHWL

SEQ ID NO: 30479 - protein, 803 aa, Pseudomonas aeruginosa
ARRTPPGWREAGRLPNRPCCRSPARCRSRTPCRACRPSLPPPSTPLSLSASFFYAFNGIAAPGRSVLMLQAVHIGVETREGALEGPRELEIVEDRAGRLGEALTRHDQRDTRRIGYQHDGRDAPFQPSDRYRLDLAAHQLVVGLGRPHRDLRQHRVHALHGLRRGVVAVTGVHGVAEVAQAHSVVALAAGLGHGGQDVEHRQVGVVTALEFEQFGDQGAPLALGDAHREQHQEGVETGFLHHQPALPEEAADDGSRNPLLAELAAGAQARGGQGDLDRIEQHVVFGDIAEAVPVGARLQHPIMGADLIGALHLLRLPDAEPPVVPVQVLPYVGQGPAEAEGLVEGLLDQRTPGGPFHHRRSHVQRSDDAVLRRGRDVHHEGFVEARHVQLPGPAILHVDHRGLAEGGEHLVRGVGGEHQGSLLAARGAHAIASVVELVERGIGVPSLVEVQHLDAVAEGLLDQLGVVAQAVVGGVGHHRQLHLRLAAARQRAGGDLRGDRLLAEFAQRDRPDDPQFVAFRSQVERYRPGHDDRVEDRLVAVAVHQHQVFATDHGVPDDLVRGGSAIDHEEGMVGAEIARGTVLGLGQGAGMVEQRSQLGDRDRQVGTQRVLPEELVERLSHRTLAIGDTAAVARRMPGIVGLRGVLDQRTEEWRQQPGQVVARRPGDLAGEERHGVFEQVEDAAQLVQVGHGLGRRVLDGHLLAEGEDRQLRRPHAGHADQFDHILQQALVFPGTFGGDQNAGQAVVGGSDDAPLGGAGGGENAEAVLLQFVGDAPHAFAGNGVGLDVAMDDEDGKFEVFIHC

SEQ ID NO: 30480 - protein, 262 aa, Pseudomonas aeruginosa
RHRPMIQIDALSAFNDNYIWLLQDATSRRCAVVDPGDAKPVEAWLAAHPDWRLSDILVTHHHHDHVGGVAALKELTGARVLGPANEKIPARDLALEDGERVEVLGLVFEIFHVPGHTLGHIAYYHPAETPLLFCGDTLFAAGCGRLFEGTPAQMHHSLARLAALPANTRVYCTHEYTLSNLRFALAVEPDNAALRERFEEATRLRERDRITLPSEISLELSTNPFLRVSEKSVKKKADQRSGQQNRTPEEVFAVLRAWKDQF

SEQ ID NO: 30481 - protein, 181 aa, Pseudomonas aeruginosa
TPWLAPFGCPSCSSPVRSPAARAAARSRGRPRPKQHVPAPEPSTSSSTPPGCIPSPARTPPTTTSGTACATVSSSRMRSAPTRASNASASGSSATSRSSNNRARAAASTCTTWSSAWKNATCRSNWRCCRSSKAPITPSPCRAATPPASGSSFPPPASISTCARPISTTVAATSPPRPMPP

SEQ ID NO: 30482 - protein, 682 aa, Pseudomonas aeruginosa
PCTWTPRAADSPLQAVPKRHARSCRRGVFASAARTPDPRPDRPALPLFSCAGKVLLLPDDSLSKIAKDPDTRLMRRLSFLILGLAVSLPSFAAITQSHGYAQFGTLKYPANFQHFDWTNPDAPKGGTLRLMASGSFDTLNPYTLKGTSPIGTGDFLQYGVNELNEPLMVGTGLYDPSGDEPASSYGLIAKSVEYAENRSWVVFNLRPEARFHDGRPITASDVAFSYRTLVKQGHPMYRTYLQEVKRVDILTPHRVRFVLRRSGNPLLILRLGELPVLPQHYWKDRDFRATTFTAPLGSGPYRIVEVDPGRRLVFERVKGWWGEKLPVNRGKYNFDRVVVDFYRDNGVAFEAFKAGEFDFYIEHQAKNWLNNYRFPAVLRGDVIRTEIPHQIPSQTQALFMNTRRAVFKERALRQALGEMFDFEWTNRALFSNSYLRSRSYYPNSEFAASGVPEGQEWLYLSPYRKQLPAQLFKQPFSLPTTEGRGIPRETLRHALGLLADAGWKLSGDRLLNKKGEPLRFEILLVNPSLERILQPYRENLASIGIDARLRTVDRAQYKQRLDQFDYDMILMTLPQTLSPGLEQWQYFHSSQVKVKGSKNYAGIANPVVDAMLNRLLGAHSRDEQVAAARALDRTLLWQYYSIPNWYLNSHRLAYRNRFAFVATPPYTLGLRAWWQKNLETSR

SEQ ID NO: 30483 - protein, 187 aa, Pseudomonas aeruginosa
SSARSRSCRNTGGPTATFPRPAWKFRWAAAPTASPRSIRDAPSATSESRTGGPRTFRSPADSITSTPSPSTPIATCRSPWKPSRPASTTSTSNIRRRTGPPATSRRHCATGASSRPASTTTTRWGCRASPSISAARCSRTAGYARRSACCSTSNGRTSSCSSAPTSAPTAISRTRRWPPTSCPAKPS

SEQ ID NO: 30484 - protein, 360 aa, Pseudomonas aeruginosa
SAISSTPWSIRASTSRTGSNPMRLSPINQRRWARFKSNKRGWWSLWLFLILFVGSLGAELIANDKPLVVHYDGGWYFPVFKRYPETTFGGEFPLEANYKSPYISQLIAEKDGWVLWPPIPYSYDTINYELKVPAPAPPSAENWLGTDDQARDVLARVIYGFRVSILFALTLTVLSSLIGVTVGALQGYYGGWVDLLGQRFLEVWSGLPVLYLLIILASFVQPNFWWLLGIMLLFSWMSLVDVVRAEFLRGRNLEYVRAARALGMRNSAIMFRHILPNAMISTLTFMPFILTGAIGTLTSLDFLGFGLPPGAPSLGELVAQGKSNLQAPWLGISAFVVLAVMLSLLVFIGEAARDAFDPRK

SEQ ID NO: 30485 - protein, 271 aa, Pseudomonas aeruginosa
DEREHSGNPRPRRRIPLRRATPAGGRRRQLRHPPGRDPGPGRRKRLGQVGDRPLDPAPAALLRRQPPSRQHPLPGRGSAQAPGTAPARDPRQPHRHGLPGTHDLAQSAAYHREAARRGPRPAQGPGWRQGQRENSRTARAGRHPRAGQAPESLSTRTLRRPAAAGDDRHGPGLRAATADRRRTDHRARRHRPVEDPRSAQGPAGTPGHVPAADHPRPQPGPAHRPPRLRHATRADRRAGFLPGTLRSPATPLYPRAAQRRAQRCAGEQPAR

SEQ ID NO: 30486 - protein, 217 aa, Pseudomonas aeruginosa
DRQRGRTGAGDHRRAGGGRARSADPLPLPPRILRRPAPAHRHRPGTGAETGTDPARRTDLGARPHRAAPGRGIAAATAGQVQPHLPVHQPRPGGGQGAQPPVDGGSTWQGGGTGQRRSGFRLAATSLYAAIAGGCLHGPGKRGKLSCRQGTDHGISHRKTRPDRRSRQQALHRFRHRRRHAPGRRRTGLHLPERQAQGPGGGVRQWLGLAAGAVLPL

SEQ ID NO: 30487 - protein, 218 aa, Pseudomonas aeruginosa
RGRRQPDRSGVRRPGQALGRPGHHRPLRRIRSRRSARRRLHRGDHPRGLPHRPRHQRLQLHRPGQGRTGNDEGPQRQPADPLLPGRRTDHAELQRNGPGQGQPGGRGPLPGRQPGRGRHPGQCGFRRADPNARRLRDQELPQDAGRQRAADAAAAQRHHRGSRQCRRLPLFGPGQRYQRRDPLRRWRLQHYRHGPAGRRLITPPMKNGRFERPFSWAE

SEQ ID NO: 30488 - protein, 103 aa, Pseudomonas aeruginosa
LTASFRALPALKPGILAAAILIGLPVCGLRPVRAARSLTAKVPKPTSTTESPAFRAPVTDSITASSARPATAFGISADAAIASISSDLFTLSPLISVEYVSMC

SEQ ID NO: 30489 - protein, 217 aa, Pseudomonas aeruginosa
CVLIRSLESGSRFSSFATISGAASGKGSGAYCSAICRTSSIHLTGLITRSLLILSGISFRSRTFSSGMITVLIPPRCAAKSFSFSPPIASTCPRRVISPVIATSARTGICVIAETSAVHMPMPALGPSFGVAPSGTWIWMSRFSWKSAAIPRLWARLRTTVNAAVIDSAITSPSDPVLVNWPLPGTTAASMVSSSPPTWVQASPVTWPIWSCCSARP

SEQ ID NO: 30490 - protein, 246 aa, Pseudomonas aeruginosa
YSRWLRSICFLTRPRMRFSTCSRSISASSSARTCSTRDDRSVISRMSCFCSIFSAMCAAMVSTSLLGSSMLFSEESTSAGTFLPNWTYCSNWLSRLRVKTSASRSPTLASSMAWTAARMCPSSSMKRSTWPRCSPSTSTLTVPSGSLSNCSTVATVPMRYRPSSPGSSSAGFFCASRRICLSPVIAASRASMDFSRPTNNGMTMCGYTTTSRSGSKGNSTSVFIMSALQRHLATKQIGRPFSLRWG

SEQ ID NO: 30491 - protein, 250 aa, Pseudomonas aeruginosa
LQTQDEGNCGHFQAHEAAECLDRQYCGALDGQVALGHDLVDQAILDSFVTAHEAVTIGIAGNDVQGLAGVVRQDLVQTLLDEENFLGMDLDIRGLALETAQRLVDHHPRMRQAVALAGGTARKQQGTHAARLTDTGGRDVGLDELHGVVDGHPGSHRTTRRVDVEMNVLLGIFSLQEQQLGNHQVGHVVLDLADQEDDPLLQQARIDVVGALAAGGLLHHHGHQATGGLDIGNVRNKRVARHVLRSLPNR

SEQ ID NO: 30492 - protein, 532 aa, Pseudomonas aeruginosa
SLKDAQASTKAGLWDSNERNESGRLRSFGRLDRFFVGYLLIGHSGLLQDSIYDLFFQYNRTDFVQLGLVLEVPGDDLLGLLVGRGHFLDHFANATFVGLQLVLLDHFGDDQAQHHTALGLLFEQLGRQLVRLDVAAELLDGLHAQTVHFVADQGLGHFDRVGLQQTFHDLVLDLGLDRLAQLALHVLLHFGAEAIETGFLHAEQSEELFVQFRQLGLGYAIDGNGELGSLVGQVQVLVVLGEGQVEHTLFTGLRPHQPFFEAGDHATGAQYQQGALGGTAGEGFAVDLADEVDVQLVIVLGGTLDHFETGVLLAQDIEHVVDISIGNFGLQALDLDVFQAGNGKFREDFEGCDVFQVLAFLEGLGLYRRRTGRIQLLLDHGFVEGFLDQIAHGFLARGSFVALTNDTHRHLAGAETWNLGTTGGLLQTLVDFGLDTLGRHTNGHAALKSGSAFNRNLHGYSSLHRRKPVLPAPRIKGMHSSRGKSRSHPARVQADPRGVSGRFRRSQPDLERVAGASPEAGAYNASRFRSDR

SEQ ID NO: 30493 - protein, 237 aa, Pseudomonas aeruginosa
NPMDCPTLSKVLLVEDDQKLARLIASFLSQHGFEVRQVHRGDAAFAAFLDFKPQVVVLDLMLPGQNGLQVCREIRRVANLPILILTAQEDDLDHILGLESGADDYVIKPIEPPVLLARLRALMRRHAPLPASPESLTFGKLNIDRRRREAELEGLGIELTTMEFELLWLLASQAGEILSRDEILNQIRGIGFDGLNRSVDVCISKLRNKLKDNPREPVRIKTVWGKGYLFNPLGWEL

SEQ ID NO: 30494 - protein, 428 aa, Pseudomonas aeruginosa
MLRLFLRLYLLLALGFAAAIFVVDHVIDAFYDSIVENYHRDAVRGQAYSLVEKLAPLDQAGRQRQLEDWRPHYGLELSLTDARQAKLTQEEQALLDKNLLVVREDFTEFISRIDAGPQLLDIKLPPEPSLTPLFTVLAYILLGVLVGIALLVWVRPHWRDLETLRLAAQRFGDGDLSSRTRIFRRSDIRTLAQHFNQMADRIESLISNQRELTNAVSHELRTPISRLSFELEQLNKQVDAEVRHDLIEDMRADLGELEEMVSELLTYARLEHGNVGSHREIVDAASWLDSVVADVALEAEAAGVTCEISACQVEQIRIEPRFMARAVINLLRNAIRHAHSRVEIALLDQGDSCQIRVNDDGPGIPADARQKIFEPFSRLDDSRDRSTGGFGLGLAIVRRVAQWHGGYAEALETPQGGASFRLTWERPR

SEQ ID NO: 30495 - protein, 121 aa, Pseudomonas aeruginosa
LVPASPGTPCPRRNAPKATAAAVAPAPPPPATSRSTTCGAARSTSAASSACCSPTGATRSASFSGNTPSRRCSASRTPAMPWTSTARWAWPGSSARAAPHRWKEASVTMSTPAPPEDSAPI

SEQ ID NO: 30496 - protein, 164 aa, Pseudomonas aeruginosa
SANENARHKAWRFEIWGGRWESNPRHQEPQSCALPTELRPPYRESCRTFRLQPQRPDKPSLKVVRTERLELSRLAALEPKSSVSTNSTTSAGHCLEMKTPGPGPGASEYGVDDGNRTHDTRSHNPVLYQLSYAHHITTCGKTSPASCRFAEWRTRQDSNLRPSA

SEQ ID NO: 30497 - protein, 395 aa, Pseudomonas aeruginosa
AQTLSSGNHKVSNRLALPLTLRPAVLGKRGACYTGGERPSTGFLKKFSYIKELRQIHGSPPLPRAASMRKCASFFHPIRWLPFRHDRTTDRRQSDRRQPSPADSPTRDRAPPARPARSRPGGDPGRHRSGLSGLCGAQAQGLRGSRLSLPGLRSSRRNQPGRPAGPDRPPERRPRHRRHPGPATPARPPGRLPAAGAHPPGQGRGRFPSLQHRPPGPAHAPPAPLHPERHHDPARQHRRRPVRHGCGRGRRLEHRRPAHGSGVAAGWLHRHRDPPLHPRPGRPCVARRPGGGRCRQAGTGQGRVDQGRRHRHRRRHQPPGRRPPGRRRGIRSGSATRQLDHPGAGRRRADDPRLPAGKYPARRRTPARLRSPVMKSPAFAGLFIYRCGFSRPGAR

SEQ ID NO: 30498 - protein, 153 aa, Pseudomonas aeruginosa
SSRSAARTWRRACRSRPRSGRSRSRDEGTPGRCHRHGCRRNRPGSRWTSPSIRCASPGAPRPRATTSSVRQAWRPSRARNRADPPSLRPARSAHRCAGPRPAAATTCRSQRTCRPGSTRPRCPARRHSPCRSGSGSSRACRRCDRWRVAPGPA

SEQ ID NO: 30499 - protein, 235 aa, Pseudomonas aeruginosa
RSSRACRHPGRLERSGAGSSGRRWSLACSWDPWSCSRPTRVGRANQSAYHSRSCQPPDRPSIFTTKRITHMIKLHTNHGVITLKLDEEKAPETAANFKEYVKSGHYDNTVFHRVINNFMIQGGGFEPGMKQKPTRAPIKNEANNGLTNKVGSIAMARTMDPHSASAQFFINVADNDFLNHTAPTTQGWGYAVFGEVVEGMDVVNKIKGVATTMRSGHQDVPAEDVIIEKAEIVEE

SEQ ID NO: 30500 - protein, 109 aa, Pseudomonas aeruginosa
SRSKRSRPRASRSPTSATWSAPVPRANPPPTRCCGSSATTFRSCRTSVPAASASAPRSHRSSTTPWKMPAPCRSSSTAPTWPWATSSTYTPMKARSLATTAAKWSPPSS

SEQ ID NO: 30501 - protein, 249 aa, Pseudomonas aeruginosa
TTGLPSIGLHTLHDVHSVVVPPAQMVGHLQAGRIDGFCAGGPWGALAVDQGQGFTIATSQAIWPDHPEKVLGTTRAFVDAYPNTARALVMAVLDASRFIEQNAENRLGTAQLISGRDYVDAPLGAIQPRFFGRYQDGLGNAWQDPHPLRFYADGEVNRPWLSDGMWFMTQFRRWGLLREDPDYLGIARRVQQTALYRDAATALGLRLDGADMRRSTLIDGRTWDGSDPAGYARSFPIHALAETGQGIAP

SEQ ID NO: 30502 - protein, 263 aa, Pseudomonas aeruginosa
HDQGGPQWTPRARSRRRPPEPHRRLSGQEMLSMIDLSTWNLTIPTEPTPQVITTQQLNNGYQSRYFQQGNDGGLVFWVPIDGSHTEDSTYPRTELRETQADGSLDNWYYWQADNELRVTMSVEKVPSKNKVIIGQIHSKSPQTDDGEPLVKLQYYYKPEEGLGRVEALVRNHPDDSYSRNVSILEQVRLGERFNYSLRVTSSGELAVRARSQDGEEDAYYQTLGSAWNDQLLYFKAGAYVNDNAGDSGEGSRVTIYHLNTAHR

SEQ ID NO: 30503 - protein, 909 aa, Pseudomonas aeruginosa
  UNSURE (386): Identity of amino acid at the above locations are unknown.
WSPRRSSPAPYCASCSACWPIAGRRRAPASSPRSSSSAALAAAWLLGVNSYEQALLLGLFLGFAGASFAVALPLASQWYPPQHQGKAMGIAGAGNSGTVLAALFAPGLAAAFGWNNVFGFALLPLVLTLLVFAMVARNAPQRPAPKAMGDYLKALGDRDSWWFMFFYSVTFGGFLGLASTLPGYFHDQYGLNPVTAGYYTAACVFAGSLMRPLGGALADRIGGIRSLLMVYTLAAICIAAVGFHLSSAMAALGLFVVAMLSLGAGNGAVFQLVPQRFHKEIGVMTGLIGMAGGIGGFCLTAGLGAIKQSTGDYQLGLWLFASLGVLAWFGLHGVKRRWRTTWGLGRGHRRAGLSVGLRLSIGEASACGPRTENQDALRVVTPAPAXAASKGHLLAIADGVSQCADGGLAARSSLQALALDYYATPETWAIVQSLDRLLLAQNRWLQANGGGQPLLTTLTALVLRGTRYTLAHVGDCRAYLWRDGELLRQTSDHVWEQPHMQHVLTRALGLDQHLVVDYLEGDLEPGSQWLLVSDGVWATLGDSGIRSILRNAEEPQRSAEALVRAAHLAGSQDNASALLVRVEAVPAGSLGDALAQLGHWPLPPPLKPDQLFEGWRVRQLLGESRQSLLYRVEDGQGQPWLLKTLPAARADDPLATQALLLEEWFLRRVQGRHFPELYGLAQRQHLYYLMREHPGETLAERLRNHGPLSLPEWLGLANQLLRGLGQLHRRNLLHRDLKPENLHLGRDGELRLLDFGLAWCPGLSREDPHLLPGTPSYLAPECFSGTSPSVRQDLYATGVCLYQALTGRYPYGEIEAFQHPRFGRPVPPSRYRPDLPAWIDDLLLRAVACDPAQRFETAEEWLLSLQQGEALPVAAPRPLLEREPLQTWRAIALLSLAANLALLLVWLKG

SEQ ID NO: 30504 - protein, 873 aa, Pseudomonas aeruginosa
RKLARRLLGFSRQSTTKRLPQRRGGVSRPNGTWTKASCWQQRDAFFVCANLMQELLRMKKIKLVMVGNGMAGVRTLEELLKLNSDFYDITVFGAEPHPNYNRILLSPVLAGEQTFEEIVLNDLNWYAENGIKLLLDRKVVQIDRVRRRVVAADGSEAEYDRLLLATGSLPFILPIPGNRLQGVIGYRDIADTQAMIDCARTHSHAVVIGGGLLGLEAANGLKQRGMDVTVVHLSDWLLERQLDRTAGKLLQGALEARGIRFRLNTQTQELMDNGSGRVCAVQFNDGDVIPADLVVMAAGIRPNTELAESAGIPCNRGILVNDTLQTYDPRIYAVGECANHRGIAYGLVAPLFEQAKVCANHLAHLGYARYQGSVTSTKLKVTGIDLFSAGDFIGGEGSETITLSDPIGGVYKKLVIKDDVLVGACLYGDTADGGWYFRQIRENHNVAQIRDHLMFGENALGDVGHQGQNSAASMPDTAEVCGCNGVCKGTIVKAIQEHGLFSVDEVKKHTKAASSCGSCAGLVEQILISTVGGAADVKPKSEKAICGCSDLNHGQIRKAIREHRLTSLDAAMRFMDWKTPNGCATCRPALNYYLISTWPGEAKDDPQSRLINERAHANIQKDGTYSVVPRMWGGVTNAAELRRIADVADKYQVPMVKVTGGQRIDLLGVKKDDLPAIWKDLDMPSGHAYGKSIRTVKTCVGSEFCRFGTQNSTQLGIDLEHDLFNMWSPHKVKLAVSGCPRNCAEAGIKDVGIIGVDSGWEMYIGGNGGIKTEVAEFFVKLKTAEEVREYNGAFLQLYREEAFYLERTVHYLQRVGMEHIRKAVVEDAENRKALNDRLQFALSFEQDPWKQRIEQPQLKKEFERIPLKQLENV

SEQ ID NO: 30505 - protein, 1181 aa, Pseudomonas aeruginosa
QEPSMSTDSPLRTTASTCCYCGVGCGVLIEHDGERILGVQGDPRHPANFGRLCSKGASLHLTGDLQARALYPQLRLGKQLARARSDWESALEHAAGRFAETIREHGPDSVAFYISGQLLTEDYYAFNKLARALVGTNNIDSNSRLCMSSAVVGYKRSLGADAPPCSYEDLDCADCVLIAGSNMAFAHPVLFRRLEAAKAARPEMRIVVIDPRRTDTCELADLHLALLPGTDVALFHGILHILLWEDWIDRSFIAEHTEGFADLKELVRDYTPAAVADICGIDRADLQRCAEWIGRSPRFLSLWCMGLNQSSAGSAKNSALINLHLATGKIGRAGCGPFSLTGQPNAMGGRETGSLANLLPGHREAADPGHRAEVAHYWGVEQLPTSPGLSAIELFDAVHDGRIKALWIACTNPAQSLPDQRKIHEALARCPFVVVQEAFAGTETCQYADLLLPAASWGEKEGSVTNSERRISHVRRAVPPPGEARQDWNIVCDFARRLEGHLRPAKPGLFAFADSRSLFDEYKLLTAGRDLDLSGLSYALLDRLGPQQWPFPTGAEQGTARLYADGRFPTASGRAQLVAEPYRAAQEKRDARYPLTLNTGRLRDQWHGMSRTGTCARLFGHEEEALVHLHPEELRRRQLQDGQLVRLKSRRGALILPVSADDSVRPGQAFLPMHWGDRFLKGLGCNVLTLPAFDPLSKQPELKHAGVQVESVELPWRLFALVETDIQARFEALRALCEVFDHASFSLAGRERPALLVSAAHHEAPGADLLERIDRQLELLDGPILAYDDPRRAIGKRVRLEDGRIVAVRLAGETLARDWLKELWLTGRADSELRRWLLAPLGAAPGRPSQGAGGKTLCSCQNVSQQTVLGGIARGLDLDGLKREFGCGTGCGSCVPEIKRLLAAPRAHGGECLRRTTMSGKVWLVGAGSRRSGTVDPEGSSRPAGRGCGDGRRSGQPEHTGALSVRPAGPGRQTRRLPLHTAGLHPAPDAAACPPGTQRGAPERRRSMHLRPRRRRSRMAGPARDRQRDSERHHRRAGWRHCLRHTADLPRHQPRRDPGDRAYPGRQPAGLGSPGTQRYHAGGLHGRRPTRGDPGRAAGWRHGRGYAAGDDRERHLGQPARMPQQPRRATAGRRTFRLEKPGDPGDRRSNPRHRVATDFPERLTSGLFPGKEKPGLGRVFP

SEQ ID NO: 30506 - protein, 101 aa, Pseudomonas aeruginosa
KLFAQAVQCPLVAHFRRTQTHVHDIRYLLKLQFRDEAKNQNLPIYRIDMDEPTIQSAPLLNLRRLLLGSLLQRVEAERIHQSALAALLAVLRDALVVRDAI

SEQ ID NO: 30507 - protein, 937 aa, Pseudomonas aeruginosa
SERTRRVPEAAVGKTPVQEDHRRSAPLAGGLLSKPGYDQLDAGIGAVAGLQAIDVFGKVGAQLGADQGDRKEATTALHACLVQEARKRAVLPALSGYSEDRSGLVLPLGKEEPGIQHRVGVQRDALDALLHQPAGQVRVVRRTLAADADVLAGLVAGSDGVGQQLLHRRIALVEQVGNDAGIAIQAQGQLGQVVGTDGEAIEELEELVGQQGVRRQFAHHDDLKAVLAALQAVPGQQLDHLARLAQGAHEGHHDLDVGQAHFVADLLQRTALQLEAVAERLADVARGTTEAEHRILFFRLVELAADQVGVLIGLEVGQAHDDLLRPERRGQGADALHQFLDVEADRIGIARDALLHAFLDVRRQAGEVQQCLGVHADHAVDDEFEAGQAHAFVRQLGEIESAIGIADVHHDLERKVGHGVDRVLAHIETEFAFEDEAGIAFGTGNGHPLAILQDLGGVAATDHRRDAQFASDDRRVAGTPAAVGDDGAGALHHRLPVRVGHVGDQDVTRLDLVHFRHVVDHLDRTGTDALADGTPFHQDGPLLFQQVALHDRGAGAALHGFRACLDDVQLAVVTVLGPFDVHRAAIVLLDDHGLLGQLGDLGVAQGEAGAIGAIDVHYLDRATGLGFVAVDHLDRLATQVAAQDGRTPGFQGRLVDVELVGVHRALDHGLAQAVGTGDEDHVAEAGFGVQGEHHPGGAGFRADHALHAGGQGDQLVIEALVHAVGDGAVVEQGGEDLFCCADHIVHAADIEEGFLLAGERGVRKVFGGSGGTHCHGEVVVAVGQGGEGLADLAVETGRELGFHHPLADLRAGLGQGVDVVDVQGVQGRVDTVVEATLLEEVTVGLGGGGKSAGYGNAGTGQVADHLAEGCVLAPHMLYIMDAELIEGNYVLYQGDLSTIELEKLKRGQEQLRWILAWPLEISDNAATERPLTTRGLS

SEQ ID NO: 30508 - protein, 284 aa, Pseudomonas aeruginosa
PRIVPTLRLSVQMKRTAFFISDGTGITAETLGQSLLAQFENISFVKLTRPYIDTEEKARAMVQQINNAAESDGARPIIFDTIVNRDIRAVLAQSNGFMIDIFATFLSPLEQELSADSSYSVGKSHSIGHNSNYMDRIEAVNFALDNDDGARTHYYDKADLILVGVSRCGKTPTCLYMALQYGIRAANYPLTEEDMERLQLPNALKQYKHKLFGLTIDPDRLTAIRNERKPNSRYASFAQCEFEVREVESLFRRENIAYINSTHFSVEEISAKILVEKGVERRFK

SEQ ID NO: 30509 - protein, 217 aa, Pseudomonas aeruginosa
PLEHRCQGRLRRHAENPGQGADVRSAVEPGLRQPQRKLRLQQLRRQHQSRRRQSQGDLVRPPRQRQADPVLPPGADQALHRREDQGERPDLPRQPAPGRPGEDRRRSPAGPHSPALGRRRDLRQRSHQARQQRQRRQRQAADGRRHQPGKESAYRRNPAVHRSRADGAGPYHPPGRRPATEPGTVAAQLQRRELAVFQRGHRRTGPALRSPDLVAWR

SEQ ID NO: 30510 - protein, 626 aa, Pseudomonas aeruginosa
AADDHRRRQEGPGQLQPEQQRDERHPPGQAVRREHRGGLPRVLPVRPAAVHPADLPDHDHDPDRRAGDPDPAQPDRPADPRHLHPGADRPGLPRDRPAMGYRPVHRDHRPGPVAALLSRAPEAADAAAPLGGADLRGGDDRGDQPVQPQARLRERPVDRPVPDGDPDHDHRTPVDHLGRARRRPCDEGGHRHPVRGIAGAHPHAHPGTGVLHLHLPGRAADPGRLHARHGPLPRLPPDRAVPLQGPAQGLNHVDLEDLERPDRERRDGHQPTQCRLRPEVQQAAPVSGGGRQDHHQGTRARGRHPRAGDVRHHRDRERHRQAQRDHRRAQRFRHQAGAGRRRRRHHGDRRPLRGPLQDRVGEDRQPRGDRAPHLEHPLRPLLPRRSSRPRTDRVPGDPRPDLQEHQLRRCAGHPHHRADGLPGDGHAAPADPAVGRQGQPAPGRHRRGRRPGHRRHPARHLAEQQDRQAPGHHQRGGRCATAELGRLHEAGGRLLRVVGPRLHRRGHGSRPGERPADPRTQRPPGPEHPDRQRQRPGAPLPRRRGATGRTQGERHRRVRGRARTLLPATVRPRPAATGLTCFRYEEARLRPGFFMSRISTHHGQLEAALPGVLMHLHTRLVHRQAL

SEQ ID NO: 30511 - protein, 415 aa, Pseudomonas aeruginosa
RTLERLVVEGLQRAVLVGGQQQHVALAAIGPHRHRTLDESVAIPGFRVQLVHRVADQPGRPLVLVEEQQRRVDHLAVGETADAQAVDPLGARQPDRRVEAPAHGKVEARREAVQLLVARFVGIQFGEVALGDLLAAAPLQVLVEIVDGHLGALEQSLQRIALLAGAIQPGQRRRTLLELDLPALGEGDLRRRRGLPLEARRALLERDLRVVHAALLVHPGVVGTAVLAANETLALEGLGVDVFGGVLAVGQDVVGALAGDLGAGIEAVLHVAVGIDPGVVATLALPSAAVPRPLRGVVRLVQHPRLVALADALPRLALLAVELAVDEGVVHPAIVVHPGQVAPAGGPARRRCRQRQGEDAKYDGCAHHAPALRRSYGRSWRKYRLSPWCPRPVPRKGCTPGCRARCSSGCSWYRP

SEQ ID NO: 30512 - protein, 585 aa, Pseudomonas aeruginosa
LFSAAWKTSSSALALSASSFFLASASRAWSTEASSATDKPLIDSISAAAHVYPLILMALSPEIVLVFGYLLLGAQVYDVATSAQLTDLVFSDLVDLRKLAERQQADGAVVHQAHVAIVQRQRVAGLLPTREDHEQDVLVPDFLEARPGEADVAQGRIGDEDVIVVDIAHHHEMLEAGIVDGDQRRMLESVQVAELGAKTTALVAQRSGVALHVEQRETAALHNLIGLAIAQQSFHDLAFLEVAPEVVVQQRGKRRRAAAVVIGLADDVAELQLAHRLQLHRFAVGSIGGQRLAEVDRALRLRLGIDRLGEPEQSDQTSQQNLEHRPVVPLSEKDPADASARSSRLDSVPGSVTPDLDGGTGHVQPGDGQRADAGGAGVAHLDGANGHVAGDGRQADGQLLGRLAADIGGDDVDGQRLGIVDGQRRQADVLQPQGAAVGVGIGVGHGPDGALESTGNADACLAGHVGQRAIVHGFQVGMRQQGSSQNSSCKEQVLFHCYFSSVQVWFAPGHCRLHPVPGRSTGISPVSRSGTASLGVPDMDSVEPHALSSWIPSYWATPSAASPSKGWSGGGCRSRLAQQSQAFTL

SEQ ID NO: 30513 - protein, 411 aa, Pseudomonas aeruginosa
LGGEQVVAGAKGVLDRPVGQVAPLAPARRRMQQRGRIGMPGQPPLEELGEQMVVAEPFALVVQGDDEQLLVLQAHEHVQAVATPGQRIAQFRIELVEHRGLVEEQLQVGGQAGQHVFRQVVGDVPFGPGEPAEETFPVGIATEGQGRQVQRRDPAFGALEQQLQLALAQLQPLEVEEKRIALLARKSQVFRAQAEGPGLEGRFVDQEARAEAGRGHHPHVIGQVLDQVANPMRQGGVADAVEIVEEQVQGAFQATQVGEEGIQDALQRHRDVGAEQIGGIAAECRDHSLDARQQVLDQTLRFAVGLVAGQPCHRRALLQQAQAQLAEDGALAEAGRRAEHHRASPAGLVQAVDQRLAGKQRQPSGAWREQLGLQQRDGAGGNPVAMAHGQSRLSSRARRIAWVRLRTLSFS

SEQ ID NO: 30514 - protein, 271 aa, Pseudomonas aeruginosa
PALPGRLQRLAVAGLSRPARGLPDAVLRLPATGRRRDPQPVAGALPQARQGQGGNPADQGHPPARQDPRGGHGAGGVAAGQPQGPRGKPDDRRPAAQRHRTQLPTWQRTGTGAVRPGKLSQRASPGEQRHRRTGAGQGRPRPAGRQLPRRLDHRRAEDSRHADHRRTGTEPTRHLLRQPVLPRRARRDGQLDRHPHPAGQERPGQLLGRRRHRRRLALGGRVPGNPGQGPGAAGNPGRDGRDSVPGIEKSPRSAGSFIGGAATDSANGWKP

SEQ ID NO: 30515 - protein, 269 aa, Pseudomonas aeruginosa
GHMPPFATIPATERNSAAQHQDPSPMSQPFDLPALASSLADKSPQDILKAAFEHFGDELWISFSGAEDVVLVDMAWKLNRNVKVFSLDTGRLHPETYRFIDQVREHYGIAIDVLSPDPRLLEPLVKEKGLFSFYRDGHGECCGIRKIEPLKRKLAGVRAWATGQRRDQSPGTRSQVAVLEIDGAFSTPEKPLYKFNPLSSMTSEEVWGYIRMLELPYNSLHERGYISIGCEPCTRPVLPNQHEREGRWWWEEATHKECGLHAGNLISKA

SEQ ID NO: 30516 - protein, 384 aa, Pseudomonas aeruginosa
SRSAGQAGRSRQSRHALRASHEKARHQAGLFHGPRRSVDRQFDAVEQLVQLGLVVALHGLGQQLAGQVRSEFLDEVAHEAAQEGAAAEADLGHAGLEQVAGVEDHQVVVELRIDRHVRHDADPQAQPHVGLDHVGIGRGEYHLGHQAALAEGFVELGAAGEAEHVGDDRLLGQGFQGQFRQLGQRMPVGHDDAAIPAVAGHHDQVAEQLQRLGGDGEVDGAVGGHFGDLHRRALVHVQGDVRVLLDEAADHVGQRIARLGVGSGDGQRALLLVGEFLGDLLDALDLAQDLAGGMDDPLPRRRHPGQVLAAASEHLDAQFVLQQADLLADARLRSIEALRRGGDVEVVVRNLPDIAQLLKLHGDSSKRLSRPAIKNRRYITILMV

SEQ ID NO: 30517 - protein, 362 aa, Pseudomonas aeruginosa
LSTTMADLQIDDLNVASNETLITPEQLKREIPLTDKALQTVAHGRQVVRDILDGKDHRLFVVIGPCSIHDIKAAHEYADRLKALAAEVADTLFLVMRVYFEKPRTTVGWKGLINDPYLDDSFKIQDGLHIGRQLLRDLAEKGLPTATEALDPISPQYLQDLISWSAIGARTTESQTHREMASGLSSAVGFKNGTDGSLTVAINALQSVSSPHRFLGINQQGGVSIVTTKGNRYGHVVLRGGNGKPNYDSVSVALCEQDLNKAKIPLNIMVDCSHANSNKDPALQPLVMDNVSNQIVEGNNSIVGLMVESHLGWGSQPIPKDLDQLQYGVSITDACIDWATTEKSIRSMHAKLKDVLPKRQRG

SEQ ID NO: 30518 - protein, 187 aa, Pseudomonas aeruginosa
HRSAGKGTVALASKGISGRFAKKQAAGRKIPETPSRKEICTGDGRTPHARNRHVNWRFSREAHAMLLKAVRNGLGQAIILADFVSRPRKLQRSAEAQAEVERALRNLSLYQFRACPFCVKTRRAMHRLNLPMQLKDAMNDPQARQALLEGGGKVKVPCLRIEENGQVRWMYESSEIIAYLEGRFANA

SEQ ID NO: 30519 - protein, 504 aa, Pseudomonas aeruginosa
TVPSGATARSLPIPSPGRVRYRRTAPVARSRANTPCGRRRPAGRKSGELPQSRPRGSSSRSAVAAKIAGLPAKKDSHSPPGGLRRMRPLVTRPTYSVPSAAWAMPLGYRAPAGRTMLVAAQDGSRSPGARAKTGKTVADTMDTSSNTEACRLIMLSPSMCALPARGPGAHRERRLQRGALLFGEVQRQRREGILEVMRPGQADDRRGDTVPAKQPGQGELRRWKPAGSGEFLQRAEGRLDFLPAAVPARGLFVRPGPQRAGASRSGQQPTRQRRPGRQRDPLFPAQRHEVLLVLANDQVVLALHRDELRQAVVALEGEHLHEAPGRHRRGAEVTDLAGTHQAVEGFAGFLDRGFRIEAMDHEEIQVVRTQPPQRGIHAGKQMLARQAAGVGPVAHGKERLGGDYQVLALREVPERASEDPLTLAGGIDIGTVEEVDPGFQRLANERTRPFLVQHPWTPRRIAIGHAPQAEPGDFQAAIAKTDMLHRTTSSEGSEKSGFPGPPCS

SEQ ID NO: 30520 - protein, 311 aa, Pseudomonas aeruginosa
SSYFNNPMKKPDLAGLAAFVAIARERSFRRAAATLGVTPPTLSHTLRELETQLGIRLLNRTTRNVSPTEAGEHLLAHLDPAFEDIAAALDSLNRFRETPHGLVRINAPRNAIGLVLAPRFGELARDYPGITLEVVADEGFANIVEAGFDAGIRLGEDLQHGMRAVRVGPDLRLAIVATPAYFRRQGRPGSPEELFGHRCIGWRKVSSGELYKWQFSKGTKALSVAVSGPLVLDDPRLMLQAALADVGIAFAIEEEVAEHLAAGRLERVLADWCAPFPGFHLYYPNRRNHPAALSTVIDLLRYPGEEHPGPA

SEQ ID NO: 30521 - protein, 810 aa, Pseudomonas aeruginosa
RLWRYSPYQWRLEARACTAARRRADNRIAVIRRTSAYRRIAPMALFALPVAAWLARTRGYRGGFIRRGTRPRESRPEGRLSMRRQDSEQLALRRLLQQQRRRLEALAVLFDQVLGAGDEVLQAVLVDELQGAPAPGGETDTEDRADVRVGGGVQYPLLHATHSLDGLDEQQAVAYVLGGYLRIGLLEAALEFRPEMFPTVRRVVVEAGAGRLARALVLIDHQVDHGERRVRRQSLALGLEVAGGLVADVGHQAQGDFVGNRQRPHRHTGLARLVVDHRGAHAFAEHGDAFVGEGAEYPRGEEAAAVVDHDRRFLDLQYVVETARQGFVAGLFAADDLHQRHLVHRAEEVQADELLRPRHRLGQTGDRQGRGIGRHYRIGQGMLLGLGGDLAFQRAVLEDRLDDQVAAFEVGFADARHDPREEGVALLGGQVPARNFLVQQPGRISLALLRRFQRDVLEHHLDAGRRRYVGDARAHHPGAEHADLFRRPHRIPLRPRLAGVDLVELEPEGADHVLRHLAGGQLGEIARLDQLRGVEIDLGALHCRAHDLLGRREATLGLVAQHRRCDGQHLRHVGTGRRTAGNLVAGAVPGLLRRRVGEDPGAGLLQHFLGAVGQFVDQPGLERFRRTHLLAFGEVRQGFLQAKQAHHAHDPAAARQQAESHLRQAELHAGIVQGDAVVAGQADLPAAAQRSAVDRGDHRLAEGLQAPQLALEFEDALVEGRGVGLGDLDQLVEIAAGEEGLLRRGQHHAGDPLFLRLQPCDGLRHRLAVDTVHGVGALPGHVHGQDDDVVLAFFVTDSVSHSGSPFTRAR

SEQ ID NO: 30522 - protein, 88 aa, Pseudomonas aeruginosa
SGRTPPPGSSPPRRTHTGTPAGPCCRHSGSCRPAPAPATPGARGAPPPSPAQPCRRRSARWPGPSGRNCAGPPGYAPGWRGSGMANRC

SEQ ID NO: 30523 - protein, 282 aa, Pseudomonas aeruginosa
SATCATWPAARRARPAEAASDVVRRGRRRQALQQVVQAGAPLAADGAEIGVVLGDPVALRQDQAVAVVDQQVQRHAHREVAADGRVERHQRAAQGLLQRRVESQVAVEDRLAVLAFAQLQERRVRRGLDEVALGIDAVQRRRSAGDLPADQEGTAQVGIAGQIAAVAGQHLAGGLGDQRRGVVDRGHVEQAGAVPADALLQQVDHRLRGRQVAGRLHHQQALAGRAEGEQLAEGGDMVDPGVGPRIGGEHQAVGQVHRDTVGHLESSLFRPSPPLKRKGNRR

SEQ ID NO: 30524 - protein, 171 aa, Pseudomonas aeruginosa
PPASLRATPPGSARQAPGEPDPAPTGRTAAGRYGAARRRSRRRSDRSTGTASVARYRPPGEPSGARGTARFPPGWPPVRPACRSRRNPGSPSPPAPAGAPGRAPVPSACDIARSARCAVAGLRRGRSGSCPARRDRSTCRRPPRYRSRWPAPGCRPGRRPAGRARRAANPG

SEQ ID NO: 30525 - protein, 456 aa, Pseudomonas aeruginosa
YQVDINHFSPAIPFGRFHAYQQLQPGSCRLFPDCGHPGVLHRSRHGRPGDPGERPRGALLADRRRFRHGLRHLVDAFRRHARLQPADPARLRPGPDPAVAAAGRRQFGLRPLAGVPGGTPLATPGAGRPADGQRHRRHALHRDGRPADDAGDRLRPAVARPLHPDRGDRLRRRAVDRLPPAPWQPAHRPGPRRRRPGDGLRHRRHALHRDGRRAVPPGQLLRRRRPRHRQRLAGGAGHRDHPGGDRHRPDRLGAGLAPRGTYLGARHLPRTSQPRADPVGPARQPDQAAQPHAPRRPPGACDPAGDPRRSPVRRAVHGPGRLQGGQRCLRPSPRRPVADRSRRAYPRQRPRPGHHRPPRRRRVRPADRGPRARRRRDPGREAGEADQPAVPDIPPRGADLGEHRHRALPRRRADPPRTDDQCRRGDVSRQGPGTERLLLLREFDERQRPGTVATAP

SEQ ID NO: 30526 - protein, 1067 aa, Pseudomonas aeruginosa
PAPGPGAPAVGLALPTQGTGAERTDGRRGSAAALGASATRTDPPRPVPAAGGKNRPDRADRRVGARRSLPADAPLAGRRACGVEHRGEPFGPAVRPCRPGRLGAQRTPAPQPGAQPPDPRGDRIDRHARCRCQPGDPRAVVGDGRRHLHRRLRHRLLQPALSQAPAGERTEDRPWLHQRAGPRQRRRRNRLGDRRPRPHAEPEDRRRGRGNRGPAGVPDPPRLQFAARLPARQADAGRAVARQRRLSAASGAPRDLSEPADSPIAVSLTSARAANTLCRARRAACRDMSRRHDERLSNNEKTCMNRLCVLGLLIGLSGSPALAAGQGESGNPPATDKERFIASLMARMSNAEKIGQLRLVSVGADHPKEALMADIRAGKVGAIFNTVTRPDIRAMQDQVRHSRLKIPLFHAYDVAHGHRTIFPISLGLAASWDPEVVARSARISALEASADGLDMSFSPMVDITRDARWGRVSEGFGEDTYLTSLLSGVMVRAYQGSNLAAPDSIMAAVKHFALYGAAEGGRDYNTVDMSLPRMFQDYLPPYKAAVDAGAGAVMVSLNTINGVPATANRWLLTDLLRQQWGFKGLTISDHGAVKELIKHGLAGNERDATRLAIQAGVDMNMNDDLYSTWLPKLLAAGEIDQADIDRACRDVLAVKYDLGLFADPYRRLGKPDDPPFDTNAESRLHRQAAREVAREGLVLLKNRDGLLPLKKQGRIAVIGPLAKSQRDVIGSWSAAGVPRQAVTVYQGLANAVGERATLLYAKGANVSGDQAILDYLNSYNPEVEVDPRSAEAMLEEALRTARDADLVVAVVGESQGMAHEASSRTDLRIPASQRRLLKALKATGKPLVLVLMNGRPLSLGWEQENADAILETWFSGTEGGNAIADVLFGEHNPSGKLTMSFPRSVGQVPVYYNHLNTGRPMDHDNPGKYTSRYFDEANGPLYPFGYGLSYTEFSLSPLRLSSERLARGATLEARVTLSNSGKRAGATVVQLYLQDPVASLSRPVKELRGFRKVMLEPGESREIVFRLGEADLKFYDSQLRHTAEPGEFKVFVGLDSAQTESRSFTLL

SEQ ID NO: 30527 - protein, 196 aa, Pseudomonas aeruginosa
RSPRHRSWRRSWPTRRAGFRPAPHSRKAGWASPAAARARPRQAAAPAVRRSAGGASGTPHRSLRRQPAGQRFQLRRQRLEQPHLGRPGPVRVARDRGRRGPAAPATAGARPRPGQWPGDSADSNWRPATTAPAATPAGRAAGPGGRAPAGFPAAGRRPGAATGRSVRRCAGGTNPSDRQQRALGPGEWPIRSTDDP

SEQ ID NO: 30528 - protein, 279 aa, Pseudomonas aeruginosa
TTAYRRSLSCAWRACRETPPTEPPTVTFGDIGAGWLTQPPSSNASGNSIQHLTCAGPCAPPAACRRRRRGAARPARCADRQPRCAPASAPARPRWNGRRRERPRGSPNAPRNAPPSRLLRLGTAAPAKSIRFSWGHSNPHADRSDRLAIAVARQQALPELGVVEQVGQGRLEAFEGQLRCENLRIQLDLPGQLVEAEMQIETVPMAVEAGELAKDPLAQHIDARHIGLQQQTLALGEQQQGDAHLFVEQQARHALFVEGQGRQTDTACELGKQSVDLAR

SEQ ID NO: 30529 - protein, 602 aa, Pseudomonas aeruginosa
VREASPGCRRRAGRPPAPVAGRCRKGSLAGSWIPLDRAENVAQDAVVFLDEAVERLDRRVVAGAGVVEQGGLLVDLVVQRTRAVAHRGGEIADRVVVLLEGVLIPEALEFPALLRRAAEKILDRQLAAEGIQIAQQRILGAVLPPGIADGIAIERGVDQIDTASVDPDALLGRQRGVDLRLDHAVDLQLRGQRLELVEQRLALAVLGLQDILVDTDDILVETAVQAEIGRHQELAQIPLRTGLPTCLQDFAEYLEALPRRRGGIGREQPGKRLEHLRLAQRLAGVGQHDPLAAQQGQQFLLLGTGRRRRRGQELVQEQLASGIKVSDFHRDSSDQQATHRRRTPRPGTLLALRRLGTAHAPQFGQQLLFGGSRQLSLRRLEQQLAGVRGKPQALPHFRQQAAAFLAVANRQFGGLDGRPQGVFGVFVHVVHGRDRRCRSLSGTVGFLSFSQASLRHHPPGLQLEPAVGGLGGAGPAAIEARHALARQWAAGQRQDLAVETLARPQRIERGLRQQVQRGEWIGQSAARLPPTQHHDPDPLAVAAPGQFAAMGQDLPAERDRGVAQAMRTHRQAAGEKPGNQRIGAHNTILPSGWMLICWVSSW

SEQ ID NO: 30530 - protein, 164 aa, Pseudomonas aeruginosa
CACSTQLASSPGTCSSAGSWGTASSSSCAARSRTSNQPGRRHPRATGTSCSCTRYSPSPIASLKRKWIPGNGTPKSRYNARRTRTSSSFSDIASRRSWRLASTSISNGTVRANSSCSARRPAFGLPPPALPRALADGAPAPCASSAGRSREPALAWARWRQSMK

SEQ ID NO: 30531 - protein, 488 aa, Pseudomonas aeruginosa
PPPPTSSARARKVRVGTPGIRPNSTSNRPPISSALGCATTCSPMSLPRSADSSEDTRGRDPGGDGDQQRRHLRDQPSPTVSTAYSCSASAVLRPFCVTPMAMPPRMLTTMMISPAMASPLTNFIAPSMEPNIWLSFSITARRARASLTSITPARMSPSMLICLPGMASREKRALTSATRSAPLVITRNCTMVMIRKMMMPTTRLPPTTKLPKVLTICPASACSRIIRVVLTDSARRNSVVISSTAGNTENCNGEPMYTDIISRTTEMVMLTAMRMSSSSGGSGSTIMNTTASSNTTSRMSLRSPTRPRSPLRSFIPAPPAPAPGRARHAPRRDARRAVRHGSGKATDRAPPRHPPATAGTGARRARRGLAGATPGARRGARRGAPAQRSARPPATPGRVAAGRIAGATSPASATGAVASVSTSSIHTLCNRFGAICSSRWSSSRSPSRQAAACRAGWRGSVRARRRSRSAWRKSPGRSRPWNSSWGRA

SEQ ID NO: 30532 - protein, 157 aa, Pseudomonas aeruginosa
NSSREAFSIVRADSSRTDPPCPRLSLLSSSGCATPSKAAGRSRSAGGSPRSPEPCSRPWCPACASANSASCAIPTRAWRYSPRSSASSSTRRCSPRSARCSGFPPTPKSALPAACIAWRLASTCSGRCSTASAAPSTAARRPSRRPGIRSTGMPRNR

SEQ ID NO: 30533 - protein, 571 aa, Pseudomonas aeruginosa
RSANTRKARTAKPTRPSRRSRRSASGCARVPTKPAITHRPARSCGASAHEPGAAVARPTPAPGPGRARPGPPIATGSRRGAGTHRAPGGATGLPRLATGRRATAVSRLPGGHARPPAPGSLAAAGRTAAGKGSRPGTGLRRDRAAPRRGARAPAAVPARTAGTPAATGEVRRTGAPRRRRAPGAARTQRGRRTGRIHPPRDLAMLKLNAVDTAPLVSSDTPAPLPPLRAQQIAFEQALPAHRPPAPRPPFDKGDETTEAEEPAATADAPTSTPLADQPAAPAADRPPTTRQAPVPVAADATPTPTPTPTPTPTPTPTPTVSPSGSVARQAPAVSARVAASTQAREPASVSAPPVDEPPLVPVSSHPQIAGRTHERPQPGPGFPAKTAAEVASTAQASVQDSPPAPTAGGEGRGEERRQPGETDPSALPPDDQAPVPLPAMQTPGDRLVARLLASSGSRPLPLADLARLLDAVQGRIQVASAAESHAARLQVRLPQLGAVEVQVLHGHGQLQVEISASPGSLAFLQQARGELLERLQRLHPEQPVQLTFNQQQDSGQRSRQRRYLHEEWQAE

SEQ ID NO: 30534 - protein, 315 aa, Pseudomonas aeruginosa
PACSDTTKHDPIARRARPDPRPGPARAGPVHRGDGDLLHQDDRGLLAAAQRPGRPADSAEHGDVRAGDHPQPVRDGTGRLRHPRLPAQPRRQPERLGIGGTLSRRGHGALPELPQAADPGARTHLLHGKHPPGLAQRIRRAARPGQPADPAAGLHSQRTDPCLRDRLPDLPALHRHRPDHLQHPPGDGHDDGVADDHFPAVQAAPVRPPRRLGAADPRPGHQLRRLTMSSADILHFTNQTLWLVLVLSLPPVLVAALIGTLVSLVQALTQIQEQTLGFVAKLVAVVVVLFATSGWLGGELYRFAEMTLLKVPLVR

SEQ ID NO: 30535 - protein, 458 aa, Pseudomonas aeruginosa
TCSSSPCRSRAWWPACCWCSTWASSWSTPTMPCCSPSTRCACCVPCWRRHERREDRAAHGEEAARRPPARPGGEEQGNCLQRVDPVAGGAADGLFRLLPGASRQAAPAARRVHRPAVSPGAGDHPGEPSPGAPLPAGAGPAGRGAGGGAQPCRPVRFPAQPRQRQAGPEEDQPGGGREEDLLDPEPGGVPQVDPEGRPALPAGLADLAGQPGQPPADSRLRAGLRGTGERADAQAADAGLRGRLPGDCRRRLRLRTPPALQAVAHEQGRGEARVQGDGGQSGDQEQAPAIPSGTAIEQPARGCPALLGDRRQPDPRRHRHTLSTRRNAPAAGHPEAHRRPGPAGPAHRRGRRNPGAATNSAGTGAAARRQCRPVHTGGPDPGHRRSPALAGKPADGYALIAIGQGGRRGTGDERRCDLAPKKRGPKAPFTCLLRVSPCPGSRVPRPRYSPAGSWSRSG

SEQ ID NO: 30536 - protein, 326 aa, Pseudomonas aeruginosa
TRGAPRPHRRPPACRWGSATSAGWSPGRHCRTGGHSRCSRGSSEKRSLAALTRVRVPFRPNWLANMDSVVKASPPAQRRALAQGAAGGEDADQHAEEQHHAAHVPGRGSARPGDHAVFAQLALARAGRQVDGLEHPVQHPGGEGPGQQVADHREAVPEHAHDGLRVFRHVLEDQAVQALVELAVEVQFEYAEEQGDAGEQRQPCTEQAASGHRAYREQRQHQRRHGIDDDPQVETHAVAERLEEGARRGRADQFAVVDQQGQAQQAEHDQQHQRAERGERQVAADGGLEQPWGRLGGSDFRLVHVYNSLFCRSISRMRSRPCSASR

SEQ ID NO: 30537 - protein, 312 aa, Pseudomonas aeruginosa
QGMSERRMKKGLAALLGEASVVVLLADGLQHVLRQSKRAQVDIGVVVAGGDAAVAEALAQRFQRKATQAFAGRTPGEGHGAADIGRHRRLVEMPVGEQPVGTCGGGAHFLQLHERRAVLGDQDATLVQAAPAGLVEVLGEQHLARADRVGGVGDDHVEAFFRGSHEAHAVVDHQVQPRVVEGALGVVGQERLAHVDHGAVDLDHGDPLDALVLGHLAQHATVAAADDQHAPGRAVGEDRHVGEHLVVDELVGLGGLDHSIERHHPAHPGVFENHQVLVLGAHLMQHVVDAEALAVALVQSFLIIAHGPGSPW

SEQ ID NO: 30538 - protein, 266 aa, Pseudomonas aeruginosa
RPLCPQLPGQRSPGLVRGATAGGTPGPGAEPQPVRPCPGRRTRGTGPPDVRPGQRPGRHRPAFRRGSPARPAGGRQSGTAPAGGLRSLRTGGARHRRPAGHGEGRGDHHRAPDPAPRRAAGRSRLRRHQPPVPDARRAGASQPRRHRHARQAGTDAATLRRGDRLGRAEPGPGGRPRGPGGAPLRVARHRPLDRRIHSPACHGRSRRLPRRRPRPAEIHGLGAARHRCAQPEGPRRGLAALARLRRDPPVAPLRRRRLTPRREATA

SEQ ID NO: 30539 - protein, 91 aa, Pseudomonas aeruginosa
GWNPWRDAPEQECSLRIAGAFTPRGCRRSWPPSDGRPGCRLRGPGRACACPRRARRPAPAPRRKGKGFPRPAGRWPRRSAHRRRFPASARW

SEQ ID NO: 30540 - protein, 137 aa, Pseudomonas aeruginosa
CRSSRKTAGPGRRPRNSRRSASAPGSSRRNRRTGPAHGPSTRAAPAPRPGRRGPSIDRRGSPGPRPCLAGPSAASPCGPRRSIAGGSRSPARHRRPPHRSRHAPPPTVRLPRSLRRVRGRSPAGAGRHRETARRKRS

SEQ ID NO: 30541 - protein, 227 aa, Pseudomonas aeruginosa
WSCGLRMKPPPAGPGARMVTDGTVPRSVFQQGEAAGDVVAGELGDPALRVVEQAHGDEMRVLAHVEPVAGAGRHRDKVVALAEHGVDMLLDMQDEQAAPGDEEAHLVFAMAVLVEELGAQFGLLRVVAVQADHVHGDVAALALEPLDLVGVGGDHLVLAGAGGDRRGGFPAFETDADLGQGRSDVLGMGQQLQRLLRLVLVIDGKAAHRLRLSTFSSHSNRNSKAST

SEQ ID NO: 30542 - protein, 176 aa, Pseudomonas aeruginosa
GRQGKTSEYTRQGRACEPSPEDAIKALSSAHEDLHAARPPRPVLPARQPGPRRSQQHPAPPLRPGHRARRAARLLAAAAQRRAAAGGPAGRRLRSHRPRRQQPLRRQQPLPAASRRGPGRTRNRQRALRQAGSRPQPGGGATRGRPQRRRLCRRRGRLERAAGPRPALLPADPGRP

SEQ ID NO: 30543 - protein, 91 aa, Pseudomonas aeruginosa
HPGRRRRRRGAPASQARLATGAHRRHEPHPADRPEHRSPAAFRLQRPEPAAGPATGRGGQPLHPARRRGGKRPLSRYRNRFPRRQVLKAGP

SEQ ID NO: 30544 - protein, 267 aa, Pseudomonas aeruginosa
RRPARGCPMIDSDTQPAAEEAEKKPPHPWAELAPEHFRLLRLAPLPTDRATGARPLRFVQLGRVERHSADQSLLRLSIQVPGLMLRKEQNLLEVWADHRNKEVRFGSDAGLSLEPLNRGLGRFLLAQAIAWAQRRWAHYKVEGGALALKDGLTEDARLRRDHFIRAQGFDVSYEDQRLLKARYSAGRVSELHSDWHKDKVQIVPLLDAAAMLEQAEQTLQAQDAEIRQLEQRINHYRRDDTSLRFTIACLTAFAVFQAGLLIWIATH

SEQ ID NO: 30545 - protein, 343 aa, Pseudomonas aeruginosa
TGGTSRLRSLFQARTEQFPVLAALRGGQHEHPVAAVLELQPGEVHFRIQRLHMDLAVAHLDDQQAFLAEVVGRLGEHPSHQVQAVVAAGQAEFRLMMELRRHVGEILGIHVGRIGHDQVEALAGKPGETVALDGVDPLAEVVALDIDVGHLQRIEGQVGEHHLRLLERIGAGDADAAGTGAEVEDSRRLGRQPGREALFDKFGDRRARHQHAFVDAEWNPAEPGFAQQVGRRNPFLDAPPEDLRQLGAFIVFQAAIQVAVRNFPGKVQGAQNQVARLVPGIVGAVTEEQAGGVETADSPADVVAQGEQTGLGHDGIAPRNAQKGDILADRAGAGLQRGKSIPL

SEQ ID NO: 30546 - protein, 226 aa, Pseudomonas aeruginosa
ETGSRQTPNPLRTPNRMNTHKHARLTFARRLEMVKQMTLEGLDAVRAAAAHGVTAPTARKWLGRYLAGGQAALADASSRPLRSPSAIDAGQGFGSSSNLRKRLMLQARIARSVGVSESTVSRVLAPAGLVQVERPGARRSRCALRTTRRPGGPAGTSNPKKPRGASCGPQPPGFTRRTGLESGPMVPRRGKPCSLGPPMNPPKVLGFTPIASPTKRNGPGGALFPA

SEQ ID NO: 30547 - protein, 79 aa, Pseudomonas aeruginosa
TANPLFFVTRKIMQLASRFATRSPVLRSERLLSDDQIRAVVPSIFVDAPHDSRSDRFFFIPSAYRAARSAGGMSLSFHG

SEQ ID NO: 30548 - protein, 160 aa, Pseudomonas aeruginosa
IRSPAFRLKGAVGTRNPEGPVATVFHEIIARDGQERANGSRQGGKRREGAARRRSRGHGPARLDGTRARATVAEKEKKSGETAGQGNGPSTRRPHGKRSAQARIKESGPEASAERSEGTKEAHQGRDAAGGSKRNAHDSATGHVYWPGDAQPLRIDSHRQ

SEQ ID NO: 30549 - protein, 249 aa, Pseudomonas aeruginosa
STWPTSAWASAWPVSWRCCSPRSGWRSPCRRTRYGKRWAARTTMRALDAGILVCGECHQLNRADGDEHPRCSRCGAVLHARRPNSLTRTWALLITAAILYIPANLLPIMTVNLFGSGMPATIMEGVVELVHADMFPIAMVVFVASILVPTFKLVGIALLLYSVQRHQPMSARQRILMYRFIEWIGRWSMLDIFVIAILVALVNFGNLASIEANLGAAAFASVVVLTMLAAVTFDPRLIWDNTNLDDENE

SEQ ID NO: 30550 - protein, 189 aa, Pseudomonas aeruginosa
SAKSEETQDLELVGDLGAAAGGPGHRCLAGVACLRPGWRGHPGSLRERRRDPGQQDRGAVQGHLGGQGDRPACQQGHQGRGRDHRDQEGSPGVPEQGHPLLAGQAAGFPGWRHRPGNPGLRRLHRGRSGEGREGRTLLHRVEGAATPFRQAARPAPDPQGRSPGLPGAGQPGVLPADPGRPGEELPVRR

SEQ ID NO: 30551 - protein, 275 aa, Pseudomonas aeruginosa
HQGGGQFLHGVEEHQHEAGADGRRDDRQGDPQEGHQGRLAESAGGFLQLRRGLFQGHADRCLGQRHEQQGIGDQQQAGGLVGGWQVVQREVHQRECDHQSRQRLQQVRQALGPARQGAGVAHHQDAYGQRQQATEQGPAEGQRQGGKQGRGDFHQREAGRGAFVQPITEHHQGDTGTDQHQRRQQRLERPLAEPQADSFGPPRAALAGAYQAAAAAHAQLQPEQQEAQCQEYRGEHRRGGVAELQFELLVDGCGEGLVAQDRQRAELHQHVQRHQ

SEQ ID NO: 30552 - protein, 286 aa, Pseudomonas aeruginosa
SGGGQGRAQQRQGDPQEHLAPRQTEHPRRLLQGRIDAAQGRCYRQVDQRILGHGHDQDGAAEAFVHRAQRNPGETADEGGDGERQAQHHVPEAPCRQVAALDAPGQGQAEQGAEQGHAEHQPQGVAQQAEYVGAPEQLPGDVPAGVPGLGRDVEQRQAGQQGEEQDRQEQPEWRSPARARAQAHGRGGGADQFRPTSRSRLRASLASPRSAGVSFGGSSSANGFSAGSACIPLRIGYSADWLRIAFWPSSLSMKATNCWASLGCLLDLSTAAPETVTSAPGSWLPK

SEQ ID NO: 30553 - protein, 230 aa, Pseudomonas aeruginosa
SLSSGSRLSSESSTGSMNGVPKGRSAGSSWRRRRASSRVRSLASRSPSCRATSCRRAESCWTRSAKASLERLSSSWDASSWASSASFSGSSAVSVWVRRKSSRAFCASSTSWYSFSAWALLAARSAATLCWVLSCFSSFSRRSFWSRRAARSARACNAGGSMCDRSMLSPGASKCSPLKWSRMASTLFTQTSPSSRFTPFSPSGRLNSAPLNRRIRRSTSCWLNSSRRRA

SEQ ID NO: 30554 - protein, 344 aa, Pseudomonas aeruginosa
TRAAEMSRACLLAALLAAPFAHAEMTALDDEQLSDVQGAGIGFVLDSAMVDGNKATIAINGVTNTATGQNVPITVKELYVAATGSNKGSTLAPVTLGRLNFPFKLNLAKGSVLTTQLDDGRVVSTLPDTADVIELAFPSLVSGAGGQPCIAGYAGAGSNCSSRASEKVDAGIRFDFGVTSTRTDVLNLDFSELAMDGSYLRFWGANARSQLVGEMRLNLYAKTFEIMSCGAGSPSCVSAAEQAARTVYLTNAYASVALGYGKSQPLLFSVTADGNFTFELPKLTLANAADFYANAPRTSLVIENLNIGGTRPGYGQVPTGGYNMGRNEISGLSFNYLKVTSHNL

SEQ ID NO: 30555 - protein, 188 aa, Pseudomonas aeruginosa
GGGGKRGTQHMAKQTHPLAGGIGILAALALLFSASAGAELRSLGDSDLDDVVGQAGISISASLNLQENPSQTRCAGGCGARLAIQPAGSGNNYLVIDDISGKFSFDEVTLDVVTIKDGFGGDGAAFNRPVLRVGLKDTSFQDLSFTIAGANKARGTDPGLVQTNLVSARIDGTLKLQGNVNIFTVAPR

SEQ ID NO: 30556 - protein, 249 aa, Pseudomonas aeruginosa
GRTVAWRDKAAPPRSKNRYHCLPERRGRNRPRASPNCRCPRFDRRTASPRLPGRDADNQLAAPPAVAVRRTLAAGVAGDPAPGRAGGACACARRDRCAAGPRPASRGAGQRAERGSRRARGRPGDPDQPAEAGRPGGEESRAGRAGRRGPGRVAGGPGPAAALRLATAAGGLLHPAGRTAHRRTLRQPRSGLPAAARPAARRRPAGQPAADRRTGTLAAAGARQPRPGAAGGPGVRPELRRRAHGGERA

SEQ ID NO: 30557 - protein, 219 aa, Pseudomonas aeruginosa
PLPVVGRPAGDPLRRRGRRGQPVPRAAGGRSGRNLGRARPGSPHGRTRPQGRAVARHAPCPSALVERDSMSDAISFRPMTEADLDAVLKIEYAAFSHPWTRGIFSEGLKNYHCWLMFEGSQQVGHGVIQIILDEAHLLNITVKPESQGRGLGLRLLEHLMREAAGHQARECFLEVRASNQAAYRLYERYGFNEIGRRRDYYPAVGGREDALFMACTLFD

SEQ ID NO: 30558 - protein, 468 aa, Pseudomonas aeruginosa
LSLGVAGWPSGTAVPLPAFRFSPAYRRQVPSCGNPSRECEVRSTAAGGRMRRLEPPMCDTLILRHQGQTWFAKNSDREPAEPQRLLRLPAVRNDPEARLRTTYLDIPQTAQRHALVISQPSWIWGAEMGVNEHGVAIGNEAVFTKLTRQRGTALLGMDLLRLGLERGASAREALEVITGLLQRYGQGGPAGYRDKRIRYDNSFLIADPGEAWVLETAGNLWAAKKVERWAISNALTLGHEFDLCSRDLEDQARRQGCWDGRGDFHFARVFDTRLLPWVGGAHRRCRINQRFLDSLPGEPDWHALFAALRHHGPRGDHFRRHNNRQVCMHAGSFWRPSQTTASLVARLRDDGPLLAATGTSAPCLGLFQPLSFDPASGAAVLSQPREAVQESPWWRFEAVHRRALTDRAFRRLLRSGRDWLERELFADLEQPDWPRLAEDAAAWHACWHDQVAMQPLAQQRWWRSHAAL

SEQ ID NO: 30559 - protein, 325 aa, Pseudomonas aeruginosa
SRPLCISKNNNAPERLRPAFGRFQRPRRSGAFSFRRVRRGWASAEHRADRFFVADPAHGFRNDRSDVQLADAATGLGSGGQRDGVGHHQLVQYGFLDVLDGTAGQHRVGAVGDDLGGAVLFQGLGGVTEGAGGIDHVVYQYAGTAFDVTDDVHHFGLVGLGTTLVDDRKVNAQGLGHGARAHHAADVRGDDHQVLEALVFDIVHQHGGTVDVVYRDIEEALDLIRVQVDREDTVDPDDGQHVGHYLGADGHAGGTRTAILAGIAEVGDDSGDTSGRGAAEGIGHHHQFHQVVVGRRAGRLNQEYVLAADVFVDFDADFAIGEFAN

SEQ ID NO: 30560 - protein, 137 aa, Pseudomonas aeruginosa
NIAKRNVQLTHDASCKIGVSVPREDHHLGHATGTCVDRRDPDEIQKRKMAGAAGFEPTHGRIKTCCLTAWRRPCGIARMPFRHSFLRPEFPASGATSRCCFLWRRTSEGGLEEGPRLYQLQLCLGSSQTHNLQCRLI

SEQ ID NO: 30561 - protein, 506 aa, Pseudomonas aeruginosa
PWRCSQNRVPLPESRGARMPTLPSICQASSSLSCCLWVFQVCASPWPSRASWEVRPAQPLSRASAEAARKRRRRMVSRSLGAGQALDGAAQHVAVGLLVEVFAPDGPGVALAPLGPEDFAQVRGDLVVGVALQRLAQVALGVGQLALAIVDPAHAVEDRRVVRVQLVRLEDQLAGLGVAGSAVGQGVAEGVEGHGVVRLAGDDEAQVLFHLRQVVALLRQHRAGVEQVEVLRVLLQTLLDGLPGLFLLVVVGQRLGFDQVQLDAVVGLLAARLVQALGGFVDATGLEQDVGLAQLRREEVIARADLGVLVEGTRGVLLFLGEAAEVEVGGVDVAVALDQFFQVDPGFVPGLGFQADQRQGETQVVVVGELLDQSGELGLGVVQAVLLHQQARVGEAHALVVRVFLDPGLEQRQGIVAALHGYATGASGAAGGPLRGGLRSCPRAGSGLRPGGRPVAAAGPCRTATGRCSGISSTGGRSSAAGRRGYPGRSPRQTGRGSRSACRPGR

SEQ ID NO: 30562 - protein, 435 aa, Pseudomonas aeruginosa
ENCAFPRLAQRSCMAFIALGINHKTASVAVRERVAFTPEQMVEALQQLCRLTTSREAAILSTCNRSELYLEIDHPTADDVLAWLADYHRLTLDELRACAYVHQDEDAVRHMMRVASGLDSMVLGEPQILGQMKSAYAVAREAGTVGPLLGRLFQATFSTAKTVRTDTAIGENPVSVAFAAVSLAKQIFSDLHRSQALLIGAGETITLVARHLFEQGVKRIVVANRTLERASLLAEQFGAHAVLLSEIPEELANSDIVISSTASQLPILGKGAVERALKQRKHKPMFMVDIAVPRDIEPEVGELDDVYLYSVDDLHEVVAENLKSRQGAAQAAEELVGSGVAEFMQRLRELAAVDVLRAYRQQAERLRDEELGKAQRQLANGADPAEVMAQLARGLTNKLLHAPSVQMKKMSAEGRIDALALAQELFALDEGAPRH

SEQ ID NO: 30563 - protein, 169 aa, Pseudomonas aeruginosa
LPGSRATTSTPSSSSSPARTACSGCRKPNPRAGSTLPPAPSRCCRSRTSRQRSRSTRPTCGWTPTVPPVPAASTSTRPTRRCASPTFPAASWLSARKSARSTRTAPRPWPGWRPSSTTSSRPRRSRRSPARASCWWARATARSASVPTTSRKGGSPTIASTSPCTPWAR

SEQ ID NO: 30564 - protein, 295 aa, Pseudomonas aeruginosa
SSRCCRNTRPINWRPWATDMTTICTLLKDSQLPDSPSARLDTELLLAAAMGKPRSFLRTWPERIVPREANERFDDWIARRRNGEPVAYILGHQGFWSLDLEVAPHTLIPRPDTELLVETALATLAADTATVLDLGTGTGAIALALASERPLWTVTAVDRVEEAVALAERNRQRLLLENVEVRRSHWFSALDGRRFRMIVGNPPYIPASDPHLSEGDVRFEPKSALVAGSDGLDDIRQIVAQAPQHLLDEGWLLLEHGYDQGAAVRELLGARGFAGVHTLRDLGGNERITLGQWAC

SEQ ID NO: 30565 - protein, 323 aa, Pseudomonas aeruginosa
SVRWWGWSVACRRWRRSSCWPVSANRWWAACCWWTPSARASANCGCVAILPVPSAGNAMAVESAAVGVFDSGVGGLSVLREIRARLPSESLLYVADNAHVPYGEKSAEYIRERCERIGDFLLEQGAKALVLACNTATAAAAAELRERYPQVPLVAMEPAVKPAAAATRNGRVGVLATTGTLKSARFAALLDRFASDVQVFTQPCPGLVERIEAGDLYGPQTRALLERLLAPILEQGCDTLILGCTHYPFVKPLLAELIPAEMAVIDTGAAVARQLERVLSARALLASGQAATPRFWTSALPEEMERILPILWGSPESVGKLVV

SEQ ID NO: 30566 - protein, 545 aa, Pseudomonas aeruginosa
RALRATIARRQVAESRQRPFAAGLQVDHRPWIVDPGEQPQAGRIVDRLALQAGQFRQPVADELAAWIEAFGLRERIEQAEVGDRVGAGGCAPLPAAVVRRQVTVDEVAHEPSFAFAPVDQQVLAEEHRYHHPQAIVHPAGGEQLAHCRVDDRYAGAPLLPGFEFRRGLAPAQGFGLLAEGAVPRDPGVADQDVLVELAPEQLVDPGRGALLAAAELAAVGNQRGVQALPGREYAGGQVGRQLAGAGKRREVAPFMVVGQMLVGEVAQAFLRYLFACRPEAAQAIGRPREGGHGIRQRVAGQRVRWLGLRTRADTRQGLVQPFVADLAELAEHLEIAASSGQHRAGGEEQLVEVAVEGHALFTQALADGLVAAFLVHPVFLVDVYRADSQLPTEPADDFRGLPPVAAVAHQQRDVQRGELALQLAQVAQPEVDLAGRIVVFPPLRRAEQVESHARAPIGGGEERAVIGGSQVAAKPDQVHRKSVHGFNRPRSPSRRRASRGVLASSRPVSARVSKASRWISTAGPTSTTGQLTPASRRGRCSGLRR

SEQ ID NO: 30567 - protein, 377 aa, Pseudomonas aeruginosa
RIDGWRRSLRHQCDASPVPWLSRKRRQGSPAGADGSSIHRITPEWGEDARSSGRSMSRVQTERARRLNEETAMHILLTGGTGLMGRRLCARWRQAGHRLTVFSRRPQQVESLCGVGVRGIDRFDEYGDQPLDAVVNLAGEPIADKPWSHKRKALLWESRVRLTERLVEWLDAREQRPDLLLSGSAVGWYGDSGERPVTEEGAAAGEDFASELCLAWEQIAREAEKLGTRVVLLRTGLVLAPEGGFLGRLLPLYRLGLGGPLGDGRQWMPWIHIEDQIELIDFLLRRPDASGPYNACAPNPVRNRDFAKALGRALHKPARIPTPGFVLRLGLGEMSGLLLGGQRALPQRLQDAGYRFQFTDLDVALADVLDARRKDQA

SEQ ID NO: 30568 - protein, 352 aa, Pseudomonas aeruginosa
WQFLTFRVGVGVGEAALSPAAYSLIADSFPRERRATAISVYSMGIYLGSGLAFLLGGLVIKFASAQGDVHLPLFGEVRPWQLIFLILGAAGVLFCLLLLAIREPARRGVGAGVAVPLGEVGAYLRANRKTVLCHNFGFACLSFAGYGSGAWVPTFFVRTHGWDAGHVGVVYGSIVAVFGCLGIVFGGRLADYWAKRGRSDANMRVGLLAAWAVIPFTLVYPLLDNANWAAALMAPTVFFLSMPFGVAPAAIQEIMPNSMRGQASAIYLFVVTLFGLGLGPTAVALVTDFVFADDMALRYSLLLVTLAAVLGAVVLLGIGLKPYRASLEHLKDWSLRREGEGGEDWKASRQPA

SEQ ID NO: 30569 - protein, 735 aa, Pseudomonas aeruginosa
LVVALQSFEIDLAVPADAGALAAAGFFGLAAQRQRFAALVHQADAGGDYGTDREIQQQAAALAYRHALLDFGRADVGRKVQRLDLELRRVVGRDPGHQQVAVVVGAAHQLVLVADRHLWITLGADQDEGVVDPVAGEHGVVHPYQRAAEIGPARVVAGLAIKAALQLHVLHAPGQVGLLVAAGAAAIAEVPAEAALARRGAAPDHPLAVPSVAVAGDADVQQAVDVEGNHQLHQRAVAVAVEILVQRQVEAAAAADRAAVGEVGQARAAAVAGADVEVAGTDGALLVEGQAGGSLVGAPAQLVLAVQGAEVAIAGAALDVLQAEAEPSRIVGVAEQVLLAAVALAVAAAGRQAEGAEGGHGDVAADAEQAQVAGGLGVGGEGQAVADAVAVDAADGVVGIGEVAQAVVVAQAPDGQVEIAQAARQQGVGYVERQAGHHLSTLGVGGHHRGFAGSVDVRHVADGEGTGLQVGAAGLVAVDEQVDGAGYGGLAVEAQQRIGDQVRTYAEVAGEAKAAHAYRGGPVQRAVDVVAQLVAVHVAFVVVQPVGVVAQVAAVEVVGVAEIAGVDAGVGDHPEAVEQALLEQRGKPGRGAVGGVRVVQVVVEQRAEAAARRGAGDQSGIVEALLRQPVRRHLQVQLLAGAVIVRPDLGQGVHRDLSGGVARQAHAGFAQGRGVEQVMAIGGVDRHHLAAVAAVDHQFQVVEDVAAAGRSGLRRRQSGQVVRRMDRGEQRQADQ

SEQ ID NO: 30570 - protein, 410 aa, Pseudomonas aeruginosa
VLVLFVERLVLPAVVARQQQVEDDGDDGAQGDALQADVVGAGTAADQHAADAEHQGHRDDHQVARFREIDLVPDQGVHADRGDGAEQQAEDAAHHRYRDALQDRAELADEGQGDGDHRRPGHDLRVVVLGQHHCAGDFRVGGVGRSAEQAGSRGGQAVAEESAVQAGLLQVVLAGDAAHRDDPADMLDGRGQAHRDDEQDRLPVEFRRGEFRQFQPGCGDDRGGVDHAEDERQGEADQHAGDDWHQAEDTLAEYRHHQGGEQRRHRDHHRGAVRQQLAAVAGLAHRHVRRNRRHRQADRDDHRADHHRRQQFIDEAGALDLHRQAHEGVDEAGGDHPAHGRGQAELALGEDDRGDEGEAGGEEHRYLAPGHQLEQQGPEAGGEQRDVGIQTGDQRHQHQRAEGDEQHLRA

SEQ ID NO: 30571 - protein, 171 aa, Pseudomonas aeruginosa
SAGSPCPEVPMFARSLCGSLLLFVSLAGLAAENPPMHARFLPPDDGQLRQEAPEQQQLIQITEYSVVLGNQRQSNQQPIPITTPTLLRLKGKPLSKGATLAQVLIQFDSEGKSLKKPVYDAGTRTLTLNYPLAQYPALLDLLRNQTVYCQFLAYPNGHVWADLHTGAVRAR

SEQ ID NO: 30572 - protein, 374 aa, Pseudomonas aeruginosa
RGSLGVDRGLHVVLRGQFQHLAATAADAAVQLGVAFQLFLASREDFLQLGAPLRRAGLLREAALDQAEHDRDGHRGARRGAQQGGDGAVVGGHQLGAELQDAAFLRILLDDLHALAGDFQAPVLGPGFGVELAQGFQALFRRLHDLADQVAGQVHVVAGHREHRQDVARAYRQRQVEERAMAQELGGETGIGAEQQGFLAVHHTGVQVRHGHRRRADLGLAVDLGLVLLDDFRVVAAQPLAAHRETTEALAFRDAGKLQERQGAAAGAEEDEACLDLAVAAVAGVLDGDPPAVIGAAQVGDLLVVADLRARLFRQVLQELVGQGAEVDVGTALDAGRGDRFVGRTTRHHQRHPLGEGGLVLGVDHGLESVVLRQ

SEQ ID NO: 30573 - protein, 135 aa, Pseudomonas aeruginosa
FEALLQVGDAFAAAHEAQMRYRVDEGLRRAEGALGDQVRPELLRHLEHGVDAHGFLDVDAAVGRLRGVVQLAQAGVAGARVVPRVGAFDRAGLLEFDDFHLQVGVEFLEQDRQGRAHDAGAYQQHVDCFVIVLRH

SEQ ID NO: 30574 - protein, 68 aa, Pseudomonas aeruginosa
TELIGGAAMLESQAYSCPYCGEPAEALLDLSAGDQQYYEDCPVCCRPILFDLRTDGQDWSLNVRREDD

SEQ ID NO: 30575 - protein, 706 aa, Pseudomonas aeruginosa
NRRAGVPDPGLTLDPELIHQAPLLLGQAGQLGAGLRGLVGAAGHLVGDLADVGDVAVDVLGHRALLLGGAGDLGIHVVDHRYRLGDRFQRLGRLARMAHAVVGALLAVLHDLHHVAGALLQLLDHALDFFGGLLGLLRQVAYLVGHHRETATLLAGAGGLDGGVEGEQVGLLGDTADRHQDRVDVFAVLGQVLHHSDRAADLAGQGLDRRRAAFDDLLALVRGLVRVVGCLGGVGGVARHVLGGGGHLVDRGGHQFDLRQLLLHALVGADGDVGGVLRGVADLLHRLHHLADHVLQFAKEGIEALGDGAQLVGALAAQAAGEVAFALGDVVEHADQLAQRPGDAVADQPDHQQAEGRYHQAGQAHAEDILLALVAQLALELLQFAEYRRLGNLQHEGPAHAAVGDGERQEQLDVAVLGVDVVERLVDREVFQVVHFVAVEDAAGGLAELAVVAGVGHQAAVAGDQRHFPGAIVELLVGALEQVLDEGQREVGTDCAAELVTDHDRHVEGRHHHGLAAHFVRGRVDDAGTLVLFRTGIELVLAHPGGQQLFAIDAVGHGLHDRLAVGAAIPPGQVAAVRAVALAGLPGEGGIGIEGIGFPGHEGVEQLGVVLHGAAQQRGDFVAAGVQLRHAVGARLAEQAGAVGQAVDHRQRILQLALDLADLGAGQGHQALVDDLLQQALGALLHQLLRSRAGEQGVQHQHHDDA

SEQ ID NO: 30576 - protein, 315 aa, Pseudomonas aeruginosa
GAYRQEDGKSLIGRRRFPRQRLLPAFEARPTMRSAFRGEQRTMAHPFRFATLAGALLLAGCQAVNTTSGGAVGVDRKQYMFSMLSSQEVDQMYAQSYQKTLGEAKSAGVLDTSSADARRVKAIAQRLIPQTAAFRPDATGWNWEVNVVKSDELNANCGPGGKIIFYTGLIDKLKLTDDEIAAVMGHEIAHALREHGREAMSKAYGVQVASQIGALAGLGQESLQLANTGVDYLMTLPNSRANENEADLIGLELAARAGYNPEAAITLWQKMGRASGGASQPEFTSTHPSDSSRMANLQAAIPKVMPLYQQARRGK

SEQ ID NO: 30577 - protein, 425 aa, Pseudomonas aeruginosa
SIRVEAYMPELPAERIAERITAFITPGRRGEAGALEEQGEGRYADVAGIVLQQVRVGVGNQHADHEDRQDVEHQDAPEHLANGDRDVLPRIFRFTGGDADQFGALEREAGDHRHPDHRLEAADEGRVAHGEVAEAGRLHAMHDAEDGRQADADEDHHRDYLDQGEPEFALAEAARGNHVEAEHDAQEDRAPVDARHLGEPETHHQLRCHQLRGDGHRPVVPVVPAEGETEAIFDEPAAIGAERAGNGHVGRHLAETGHEEVHHQPDQCVGKQRTAGPGGGHGGPGGDEQPGADGAADGDHVQVARLEHPPQLLALAGVQVSHRRPPGGWPRKGLAAGVRAGRGKASFTGFQAEIRSDGRSRCGNRRLRRVSGRGRGGVRSTAGTSGSCWRPGAVRRPAPGARRRVAAGARRPGSRCARPGGRAGC

SEQ ID NO: 30578 - protein, 349 aa, Pseudomonas aeruginosa
TPPAGSPPAARHRSAAGCSAGPGRVGRARPAPVRYAPARAGNAARYPVCGACRRRPTACSRARSRRAFRRPGRVRRRAGGRPGWPAGSRSVRGTWAGTERPKSRRRSARACRNGYGRGSGRPTAPARRRASSSPGPAVARRAGRRRAGRPAAAGSRRGGAGAAALHCEGPCGLRKKWEILTGLGLAYPHGLSARIAVHPCAVPAAPYQPALTTRRARPAFHASAFSASWPTMRCRASRLPQALWGVTIRRGMSGASSGLPFLGGSTLSTSVAAPPRWPPRRASASACSSTRPPRAVLTRKAPGFISASSAAPSIPRVSSVSGQCRVRASTRGRSSPSGRRSARAGRPGN

SEQ ID NO: 30579 - protein, 1298 aa, Pseudomonas aeruginosa
TGSPPGQESVIAGRISAPGQVIIYNSNGVVFSGSAKVDVGSLITTTANISDEHFRQGKLIFDQPGNPDARIVNDGSISVAEKGLAAFVAPSVANNGVINARLGTVAMAAGNAATIDLYGDGLVSIAVTDPVTRKPQDAQALVSNGGAIQADGGSVLITAEQASRVVDNAVNLSGVILARGTEVREGSVALVSKSGDIQVAGKIDVSGPKSGGDVLVSGQQVALASTASIDARGAAQGGSVRIGGDFQGRGELPRAKNATLAKGASIDVSATGKGNGGLAVVWSDGNTRMDGRILARGGAQGGNGGLVETSGKVNLSIADSAYVSVAAPYGNGGTWLLDPTTLRIVASGGTSGSVGGANGASGDATVNASVVTGALAGGKVTLSASDRLSVEAPLITSNLGGASRGLELIATGPAGAVDISAPILFRNGSLAIRAGGNISFLSGGTPQTSGIVDLGSGTLWMQTSTAGKISQQAGTALIAANLAGRAGSIDLASWDNYAGNLALQTFNGTLKYRQSNATGVTTSGTVFDPFINQSMTGTAQNIVSSVGTRILEANSVGTTGNYTLTADGNSEFDRLVFTALPYRRVSGSASFPTNDSSDYLVTNLRYQVNGSNVTATPNGGAPSGFTVAAGNGSVTTWTGNWGTSWGVKGFGGVIGVTDELQYDVGTGLTEELIFGLGGKTSRVDTRLDLFMREGAFNSFAERAQVEMFKTTTTAGDILSRQQTATLTANDATRVYGDVNPTLTATMSGINAIDAYVNSQFNDLYQATASTTATQASNVGQYAITGNANGSEYFSQRYQLVRQDGKLTVTPAQLIVSADAKTKVYGDADPTLTYQVSGLKNSDTAAGVLSGNLGRVAGENVGNYGILQGGLGLNTANYTLSYVGNDLRITPAQLNVIADAKTKVYGDLDPALTYQVSGLKRGDTAGAVLNGGSLSRVAGENVGVYGINQGGLGLVSSNYTLNYQGNNLTITKALLNVIADAKTKVYGDADPALTYQVSGLKNGDTAGAVLNGGSLSRVAGENVGVYGINQGGLGLVSANYDLSYQGNNLTITKALLNVIADAKTKVYGDADPSLTYQVSGLKNGDTAGAVLNGGSLSRVAGENVGVYGINQGDLALNSGNYDLSYQGNNLTITKALLNVIADAKTKVYGDADPSLTYQVSGLKNGDTAGAVLNGGGLVRVSGENVGNYAIQQGGLGLVSGNYDLAYQGNNLTITKALLNVIADAKTKVYGDADPSLTYQVSGLKNGDSAGSILTGGLNRAAGENVGVYGINQGDLALNSGNYQLSYQGNNLTITKHCSM

SEQ ID NO: 30580 - protein, 982 aa, Pseudomonas aeruginosa
PTRSGGLKNGDTAGAVFNGGSMSRVAGENVGVYGINQGDLALNSGNYDLSYQGNNLTITKALLNVIADAKTKVYGDADPSLTYQVSGLKNGDTAGAVLNGGGLVRVSGENVGNYAIQQGGLGLVSGNYDLAYQGNNLTITKALLNVIADGKTKVYGDADPSLTYQVSGLKNGDSAGSILTGGLNRAAGENVGVYGINQGDLALNSGNYDLSYQGNNLTITKALLNVIADGKTKVYGDADPSLTYQVSGLKNGDTAGAVLNSGSLSRVAGENVGVYGINQGGLGLVSGNYDLAYQGNNLTITKALLNVIADGKTKVYGDADPSLTYQVSGLRNGDSAGSILTGGLNRDAGENVGVYGINQGDLALNSGNYDLSYQGNNLTITKALLNVIADAKTKVYGDADPSLTYQVSGLKNGDTAGAVLNGGSLSRVAGENVGVYGINQGDLALNSGNYDLSYQGNNLTITKALLNVIADAKTKVYGDADPSLTYQVSGLKNGDTAGAVLNGGGLVRVSGENVGNYAIQQGGLGLVSGNYDLAYQGNNLTITKALLNVIADAKTKVYGDADPSLTYQVSGLKNGDTAGSILTGGLNRAAGENVGVYGINQGDLALNSGNYDLSYQGNNLTITKALLNVIADAKTKVYGDADPSLTYQVSGLKNGDTAGAVLNGGGLVRVSGENVGNYAIQQGGLGLVSGNYDLAYQGNNLTITKALLNVIADGKTKVYGDADPSLTYQVSGLKNGDSAGSILTGGLNRDAGENVGVYGINQGGLVLTSGNYDLAYQGNDLTITKALLNVFADAKSKQVGTADPALTYQVSGLKNGDSAGQVLAGGLGRVGGEAVGQYDILQGGLALTSGNYQLNYQGNLLSILPLPVTPGDLGQLAALSDLRELQKGRDPDTPGDAVYRTTTLENPFLENPFLRAYALGMDVSDPNLLPATAAGPAEDASAKRVGQFTDRPLRAEAESGAGCSNQSYLADYWSCFNKPLNF

SEQ ID NO: 30581 - protein, 162 aa, Pseudomonas aeruginosa
PKNVRWMPIPWSAACCWSATCRGSTCRACSARVRRWARRTSTWPCSSSDTKASSASTTAARTTPTRPPWPSAPPSSPAWASTSRSTYSARSRRSAMPPATSSCAVRCRWVACSPAIPCRSWVPIRRSTRTFRTRYSPSTASARAPKAAFPTTIPSSARARRT

SEQ ID NO: 30582 - protein, 149 aa, Pseudomonas aeruginosa
SSNRAMARRWAIAGCAATRPTLSTTGARPTTSTWTMTSSRSSARSVPGCASTSPTSCRSTRRLPARSSASQPTSAMGSARRGSCSTWWRASEPCRPPFRRLLTEPLSGSAEREVRAQFRVFFSNFRFLRFFISMPSIRVKAGRRGVFLL

SEQ ID NO: 30583 - protein, 212 aa, Pseudomonas aeruginosa
SRWSAPSPTPWRTPPASASATCPSLPPASRRPSMANRKLQMTLNGQAVGPVEVAEDLPMIDYLHEYQNLTGSRLGCGQGICHACVVIVDNPDGTSEEVRTCITGAHYFDGKKVRTIEGHAQRDENGDIRELNPIQQKFVDQFAFQCSYCAPGFVNAATVLVEKAQRQPIKRSELEQAIEDSLGHHICRCTGYVRYYSATRDVLDELGLVKEA

SEQ ID NO: 30584 - protein, 98 aa, Pseudomonas aeruginosa
AWRGSPGGGCRRSTVRRPPPGHREPGETCARRGSRRPPAAGGTAGCTGPGPASPPPGRPGHRRRGTSPAARPAPLASFPAPTARPCTTHPPGSARPAG

SEQ ID NO: 30585 - protein, 140 aa, Pseudomonas aeruginosa
LPTCSPCVPAVTRDSGSAPGNSPGSACTSPAAVSSGAPTRWFRRLMTNSSTSFPSSSRTASSPANSAACARATSCWSIARPSASSPSTASWMVVTFGCWPPVPVWRRSSRSCRTSRSGSASKASSWSTACVRARSWPTAS

SEQ ID NO: 30586 - protein, 222 aa, Pseudomonas aeruginosa
PSHAGGEVAEFDRRCRPSPPVRLDRRHVSEFDSSSSLAKAAKAFFSKIQLRSADMDKRLLSKGLVLGLLSLGSMTAHADAAGGNGCGWGNMVFEGQRGLFPHLLATTTNGTSGNATFGMTSGTNGCNTNARLGYGGRSIFAMNGMLDNIAEDMAKGQGEALDAYAVLLGVEAKDRAHFAQVTQQHFGEIFASKDATGEQVLSNTLAVMSRDGTLARYAKQPA

SEQ ID NO: 30587 - protein, 694 aa, Pseudomonas aeruginosa
PATSPRLAGGGDRGRRGPGRRRPASWRSDQRLVDRGGGGGHLPGRLPLLQPVHRQQGDATGPQPRHSRGTQQRWPGLRPDQQAHPLRPPLRRHRRRRSAGRSGPCRADGLPARHPLADRRRSPRRRGAGLHGPVHLQPSQRPLAGRAGARGNGPGGRDHRAVRRLPDHDHHPRGARADRGEGSGRQPLGHVHRPRDHSHRAVHGRLHALHPPRPDRRDLDHRGVPPARFDLARRAGRGQSGMGAAFHLQWNPDHLDADRLRRRRLGTAGVAAAGAARLPVDLPQDRHHHRPGDRHPDRHAGTEDAGPDPVHRRHRPGLERQPVPVPVHHHRLRRGVRLPRADLLGDHAEAAQPRARRPLHRLRRHADGVLRGDHGDGRRLGDRAGHLLRHEQPAGGGRRRRQRGGRDRQQLGLRHHAGATHPDRPGHRRDHHPGPCRRRADPGGGDRAHPPPGAAGREHHGLLVPLRDPLRGLVHPHRGGRRHPCRALHAAGPAGQLRAGAEEDRVVDRQHHRHRRLRGAVGLAAVPGRGRPAGRDQYPVAAVRHFQPDARRHRADARHRGPDQDEAPAVCLGHHPAGGLVADLHHHRGPDQDLRQQPGGRLRRSWREVRHRAGCRPGAGAGQGYRPDAARGAERLHQRRSDRAVPAGGVQRTVLRHQGRHRGLGQERADRQGNPVRAHPRRLTGRAPRFAGEP

SEQ ID NO: 30588 - protein, 344 aa, Pseudomonas aeruginosa
RGPRLFWKLRMSEVANDNHAPIPVTVLTGFLGAGKTTLLKYLLQAEHGMKIAVIENEYSETPIDGQLLGVEPVQVMTLSNGCVCCSINTDLEKALFLLLERRDNGEIDFDRLVIECTGLADPAPVAQTFFADEELCQRYVLDGIITLVDAANAERHLQETIAQAQVGFADRILVSKTDLVDAATFEALGQRLQRINRRALVHVVEHGRIDLAHLLDVRGFNLNADLGPGIGLRPLRAVAAKDSRDRIGTLVLRSDTPLDLERLSEFMDDLLQWHGNSLLRYKGVLNIADEPRRLVFQGVLRLYGFDWDSEWRDDEARESVIVFIGDNLPEDSIREGFERIVEGR

SEQ ID NO: 30589 - protein, 601 aa, Pseudomonas aeruginosa
GASTPKERGNGQERIDRRLAGLHPWRGQILGAVRPGHLRDPHAAGAGPRGPGAGIAGRVGSGTGRHAGGRLRCDHPGQRPRLGGDRASPGHPYLRPSRGTGGGRRRAARRHARPLPAGRGCRGLGGDPCRGPAITLPGASSLGGNEKARHLPGSFVLPCRLVAVDRELGADRLDLLAYAVDHGLVAHVLEDVADPAGQLAALGFLEAAGGHGRGTDAQAGGDERRARVVRDRVLVHGDERAAEGGVGVFAGDVLLDQGEQEQVVLGAAGNYVETAVEEDLGHGLGVLQDLLLVGLELRLQGFLEAHRLGRDHVLQRTALGAGEYRGVELLLDLLVGARQDQATARTAQGLVGGGGDHVGERHRVRVDASGDQAGDVGHVDEQVGADLVGDGAEAGEIEDLGIGGEAGDDHLRLVLHGQALDFVVVDQAIGVDAVLHSVVQLAGGGDAGAVGQVAAMGQAHAEDGVAGRQQGQVDRGVGLGAGVRLDVGVIGAEQLLGAVDGQLLDDIDVLAAAVVALVRITFGVLVGQHRTLGFHHRRAGVVLGGDQLDVLFLALGFLLHRGKEFGIVAGEGQITAEHGGPHKDRCWEKARILTHAAGAGT

SEQ ID NO: 30590 - protein, 410 aa, Pseudomonas aeruginosa
DNIDSISSKKYHSIRFQSTVGCVMADLRAIGRIGALAMAIALAGCGPAEERQEAAEMVLPVEVLTVQAEPLALSSELPGRIEPVRVAEVRARVAGIVVRKRFEEGADVKAGDLLFQIDPAPLKAAVSRAEGELARNRAVLFEAQARVRRYEPLVKIQAVSQQDFDTATADLRSAEAATRSAQADLETARLNLGYASVTAPISGRIGRALVTEGALVGQGEATLMARIQQFDPIYADFTQTAAEALRLRDALKKGTLAAGDSQALTLRVEGTPYERQGALQFADVAVDRGTGQIALRGKFANPDGVLLPGMYVRVRTPQGIDNQAILVPQRAVHRSSDGSAQVMVVGADERAESRSVGTGVMQGSRWQITEGLEPGDRVIVGGLAAVQPGVKIVPKPDGAQAQAQSPAPQQ

SEQ ID NO: 30591 - protein, 1052 aa, Pseudomonas aeruginosa
GRVRPEDFPMSEFFIKRPNFAWVVALFISLAGLLVISKLPVAQYPNVAPPQITITATYPGASAKVLVDSVTSVLEESLNGAKGLLYFESTNNSNGTAEIVVTFEPGTDPDLAQVDVQNRLKKAEARMPQAVLTQGLQVEQTSAGFLLIYALSYKEGAQRSDTTALGDYAARNINNELRRLPGVGKLQFFSSEAAMRVWIDPQKLVGFGLSIDDVSNAIRGQNVQVPAGAFGSAPGSSAQELTATLAVKGTLDDPQEFGQVVLRANQDGSLVRLADVARLELGKESYNISSRLNGTPTVGGAIQLSPGANAIQTATLVKQRLAELSAFFPEDMQYSVPYDTSRFVDVAIEKVIHTLIEAMVLVFLGMFLFLQNVRYTLIPSIVVPVCLLGTLMLMYLLGFSVNMMTMFGMVLAIGILVDDAIVVVENVERIMAEEGISPAEATVKAMKQVSGAIVGITLVLSAVFLPLAFMAGSVGVIYQQFSVSLAVSILFSGFLALTFTPALCATLLKPIPEGHHEKRGFFGAFNRGFARVTERYSLLNSKLVARAGRFMLVYAGLVAMLGYFYLRLPEAFVPAEDLGYMVVDVQLPPGASRVRTDATGEELERFLKSREAVASVFLISGFSFSGQGDNAALAFPTFKDWSERGAEQSAAAEIAALNEHFALPDDGTVMAVSPPPINGLGNSGGFALRLMDRTGVGREALLQARDTLLGEIQTNPKFLYAMMEGLAEAPQLRLLIDREKARALGVSFETISGTLSAAFGSEVINDFTNAGRQQRVVIQAEQGNRMTPESVLELYVPNAAGNLVPLSAFVSVKWEEGPVQLVRYNGYPSIRIVGDAAPGFSTGEAMAEMERLAAQLPAGIGYEWTGLSYQEKVSAGQATSLFALAILVVFLLLVALYESWSIPLSVMLIVPIGAIGAVLAVMVSGMSNDVYFKVGLITIIGLSAKNAILIVEFAKELWEQGHSLRDAAIEAARLRFRPIIMTSMAFILGVIPLALASGAGAASQRAIGTGVIGGMLSATFLGVLFVPICFVWLLSLLRSKPAPIEQAASAGE

SEQ ID NO: 30592 - protein, 778 aa, Pseudomonas aeruginosa
SGTTPIWMTRMSDLPSPKKHKTSNWSAIWVLPLVALAIGAWLAWRAFDQAGVDIQVRFESGDGIQANKTEVLYKGISVGKVTDLHVSKDIKGVVATIEIKKEAQEYLSKDTRFWLVKPRVSLAGVTGLETLVSGVYIAVDPVKGEKEERYFTALKEPPPLSDKLPGLHLTLKADRLGSLEQGSPVFYRQIQVGQVKSFQLGDDQRTIEIKVHIEPAYADLVRKHTRFWNASGISISGGLSGFKVHSESLLTLVAGGIAFSTPENRTDSPPTDPSKPFRLYDDYDAAQAGLRVKLKMNDVSGIDPGRTPVMFNGVQVGLVKSIDMGKDYSSATADLAMDPRVEDMLLEGTEFWTVKPSISLAGITGLEALVKGNYIDVRFAKSGAPSREFTIRPKAPPLNTDAPGLHLVLTSDKLGSIDIGAPILYRQVRVGSVQSYQLSRDRQRVVVGVHIEPEYAHLVNTSTRFWNSSGITLTGNLSGVQVKSESLQTLITGGISFDTLDPKAPTVTKVRRFTLFDSEEAAMARGVEIQLSIDNADGLREGTPIRFKGLDIGKIESVELNPDLSGVLMKARLTSAGERVARSGTRFWVVRPALGLLRTENLGTLVSGPYIEALPSSTPGERQARFQTLAEAPNLLGRENGLRLTLSAPRKGSIKPGNLVTYRQIPVGKVVDLALGEQADRVLISILIEPRYVPLVRTGSRFWNASGFGVDASLFKGLSLRTESMEALMEGGIAFATPNNAQMGEPAKPGQTFALFDSANDEWLEWAPKIPLKETARR

SEQ ID NO: 30593 - protein, 155 aa, Pseudomonas aeruginosa
EVEQAWILPVGYKCECNQLYLRGSFGPIGKVHGPVRQGRGRRFTPVRRLPPARWLRGFRRWRRHPGDGCISSPLRRYKCRSGRYRLPGRSPRVRKPAASRSPGSARSPVAGWSPAARPGCARRCPPPRPGSRAGARARPARGPSGAATGTCWSAP

SEQ ID NO: 30594 - protein, 133 aa, Pseudomonas aeruginosa
APTARRASAGCRRSRAPGASAPGCRHAVRSAGRPARRGIARAGSAVPRGAPRRSRARCRAGCRAAVKGGASCRAVRRAGSRRWPGLPPAGRRRPAPGSPAPSAARRGRPPRRRRCSRHYPSAGCARRRRGTAA

SEQ ID NO: 30595 - protein, 365 aa, Pseudomonas aeruginosa
ASPSLAPTRRAVPIPGWCRPTWSAHASTAPSSCRATSISSPSPRVEGEPSHGGTKPLRRGRRTAIIACLNAGGETVPAHRLIAGARDLIEEQRRRAFLGAMQITSWLPRQPLPFAAPSRPELLETPPREEPAVPVRARAAIDAPQARVPQAEAPASAPSVAPAAPVEGRGIPISLPKPGAPAAKKAEPVAPVEEAPAESPAVQAPPPRFALQLLQAGSCTLLVELPTGEPFASRDPGYLLLRDLLRAAGLPDSPRLIGEPVRWPLLARGNLDQGPQAALEFVQSFVAARMEESERSRCLWLVGLPAIRFAGEGDEGSLFRELQVDGLGATWAVPGLEALMEEPALKGELWRAMRRVRQRWSSEIQ

SEQ ID NO: 30596 - protein, 469 aa, Pseudomonas aeruginosa
PLATNSTCAAATSRTRLAARAAGMVAATSTSRGSSTPACYPGSAARTGAVGSTSASSTACLVSRTGTRCSPRCATMARAGTTSAATTTARYACTPAASGGLRRPPPVWSPACATTARCWPPPVLRRRAWDCSSRCPSIRPPAPPCSASRARRYRSPPGGASRRCTAARSPTAPSAGSCAAAAIGWNGNSSPTSNSPTGRAWQRMPQPGTPVGMIRSPCSRWRSSAGGVATPRCDACQTGIAFRKVLHRSNEGHAMSDLQQLFENNVRWAEAIKQEDPDFFAKLARQQTPEYLWIGCSDARVPANEIVGMLPGDLFVHRNVANVVLHTDLNCLSVIQFAVDVLKVKHILVTGHYGCGGVRASLHNDQLGLIDGWLRSIRDLAYEYREHLEQLPTEEERVDRLCELNVIQQVANVSHTSIVQNAWHRGQSLSVHGCIYGIKDGLWKNLNVTVSGLDQLPPQYRLSPLGGCC

SEQ ID NO: 30597 - protein, 652 aa, Pseudomonas aeruginosa
ERRKLFPTSSPLPGGTGELSRTASELHAIRQAVGPPPSLVVEQSRWCEPAVVDLRALSPDRGVVLVQQVLDARGEGAHRQRLGAEQVEQRVAVDLVARLVVQVEGAHALQAQAALVVLPADEGAGLGRAGRGHVLLQPAAVDLFLGADGQAVDADLPVIVQPVGSLALQAVVALLGVLLQHRQGLRVVLDALVRPGIERRHLGIQGTVGVPPAQLDLLGLDPVQRRVVHADPLQQRVVAIAVGCAVASETVVLGRIRQLEAFAVVGPDLLLQVQLVDGADVDQVDVVVLAPARNRVGGLAEAVGDEDLLVRRNEVADVGAHRLAPHAGAQGQVVGGLPTALEEEGAAVGIDVRVAAQLGLFTGYQPAAGGGERQVEEHLVGREFFPVQVHPVGQAGALPGLHQGQFHPVVVGVLLRGRVVGGAVVDRAGIAVADGREGIEGHLLVAVVGLQVEVVTQHFRRVVGGVELMALALRLAVEVDAALDRIGCPSAQGVEVAPKIEAAVAVVAGVVVLQAEIEAVAIGESEAKAAHQVHRPVVLQVGLGDVRQYLVATAVVGRAVLLVGDGQAAVEQVVAAADRLRRAQVVVLMALEAAAGAQLGVEASVAADALLGHDVDDPAGGAAAVHRAGAGHHLDALDVEWVDGVELPADAP

SEQ ID NO: 30598 - protein, 61 aa, Pseudomonas aeruginosa
GMPGIQSKMKCLTRGAAHGVALQRILGHSSMMMRYAHLSPEHLESAMRFSPITQSGYKLTT

SEQ ID NO: 30599 - protein, 108 aa, Pseudomonas aeruginosa
LPLRRWTMATNGMRPIHPGEILRDEFLMELDISPAALARALKVSAPTVNDIVREQRGISADMAIRLGRYFDTSAQFWMNLQSEYSLATAYAANGKQIEHEIEPLLAHG

SEQ ID NO: 30600 - protein, 514 aa, Pseudomonas aeruginosa
PSGAHFPYLGRGCQPLGLDNFLIFQSFRRKGSDRRREGDGEGQERKAPALGRGFPGTGRGLHVEAEMHHVAVLDDVVLAFQAPFAGFLGALFALELDEVVVGDHFGADEAFLEVGVDHAGGLRGGGADADGPGADFLHPGGEVGLQVEQAVAGTDHTVQAGFLETEGLEEHVLLFAVFQLGDLGFDLVAHRHHHRAFFLGDGLHHIQVRVVLEAVLGDVGDVHHRLAGQQVEAAHQALLLVTEVLQQRTRRLALGEVGDELFQQGLLGQGFLVAALGVAGDFLQLLLAAVEVGEDQFEVDDLDVALGVDAVGHVDHVVVFEAAHHVGDGVGLADVGEELVAQALTLGGARHQAGDVDEFHGGRQYALGLDDLGQGVQARVGHRHDAAVRLDGAEREVFRRDTGFGQGVEQGGLADVGQADDAAVESHAMSLALRQALEKWFRPSGCAASASPGSSPRRAFPAARRGRSRCWCRAVPARCAVRGRARNRKPGCCAPDGRCQAAGDGKNSDCRAGR

SEQ ID NO: 30601 - protein, 192 aa, Pseudomonas aeruginosa
KNFCCADKYLRNHDEIPGLRDVHRGELFAHALGESRASAGEDRHVGAQAQAQGGDAVLVPAELPEMVQGQERRGGVGAAAADAAPHGQALVQPDVDALRAAGGFLQPARGAHDQVAVVRHPGDFRVQAYLAVLAGFEMQLVAVVEELEQCLQLVIAIVAAAEDMQEQIELGRGWQAEAHAHVSGRAGAAASP

SEQ ID NO: 30602 - protein, 226 aa, Pseudomonas aeruginosa
PDPLPRLFPRVRRGRTGDPGVPRLPQGAGRSRGRPGVAQGQRPGVARPRRGGGRRSARPPRRPRRQPAAHAAAEGSQRQPQRVPGDPCRHRWRRGGDLLRRPVPHVFALRRAPGLAGRDAVGERGRARWLQGSDCPGRGRQRLRQAQVRVRRAPRAAGAGNRIPGPDPHFRLHRRGAAGAGRAGSDRDQPGRPAGGHLPFLRCRRPARQQDRLGGAHHPHSQRHRG

SEQ ID NO: 30603 - protein, 185 aa, Pseudomonas aeruginosa
ARATCVSSRRARWSRVAMASTISARSSPRRRSICWTKAGCCSSTAMIKGRRCANCSAPAASPGYIRCATSAATSGSLSDNGHAERRGTAALQSPDPAGAGRRRGPAAPEAQPRTDRRSWRPGFAGGAVPGRGRGRRAAPGGFRYGRPDQPATAGHPRWHQRRCRQGGVGDAPAGRAESADPPGQP

SEQ ID NO: 30604 - protein, 195 aa, Pseudomonas aeruginosa
VRSYNAQLECGGFHATFEKDVSMKKLLPLAVLAALSSVHVASAQAADVSAAVGATGQSGMTYRLGLSWDWDKSWWQTSTGRLTGYWDAGYTYWEGGDEGAGKHSLSFAPVFVYEFAGDSIKPFIEAGIGVAAFSGTRVGDQNLGSSLNFEDRIGAGLKFANGQSVGVRAIHYSNAGLKQPNDGIESYSLFYKIPI

SEQ ID NO: 30605 - protein, 157 aa, Pseudomonas aeruginosa
LRGSAGRRVRGGASSSGNPRARCAGRVRSGAVAGRPAGRCMHAGGDGSGALAGSAVPLAARCHAGIARSARAIHACLRLRGRVSGSRSGAATRCHGCRGSRSGASPASARRSSECRGLPAGSGRLRRAGGRGCGSAPANGPATGTCSGYGRRRWPNG

SEQ ID NO: 30606 - protein, 410 aa, Pseudomonas aeruginosa
IFSCHIGPPGDGPIPSEMFQQAPRGFLAAEPGAFDAAAGAPVAAGVDAQVGIAEGAPLVGLRRACIEPAVGDAEGGFRYGAADHFGEGAAQVLDHVLLGHVDVLPAPLAGGVQHPGVEGGVAPRLAAIAGQPGDRTAVHEAALHRGVEYLAEAQRHRPGRLHDHARGGGRQFRHAGQQRRGLGSGDGDQDLVERTVVLSLGVLQVPVLLAAEDLGDAAGEDHLQIGEQGAGDRTHPRDADPAWLLVRGGAQLAVAVLVESGFPLVHPAFLAPVLQGVEEAPVAGGEVLRAEVQRAGLAALAGHAAAAAVALVEQLYGLAGGSQCVGGGKPGDASTDDGDGDAHDMPLWLCSVWTGESGFLYKLDLMYSIARASRRTLHRADGAPAAHGSLPGLSNLQTFRSEVSTELSEE

SEQ ID NO: 30607 - protein, 442 aa, Pseudomonas aeruginosa
SIFFCGGPMPAVPIMRALPTRCATAISPRPWAGRCTSRRGYRPPGSSCASGWEKCPDCCSAASEPCRNACRTPATVFNSPTWTWRWPMSWTPDERIRHDRECPAVAQPGLPGFDPGGGCPPLSRPVPHGSLRGRPALAAAAPAGVADPDQASGRIGARLQLDLVGRRVATDRPQSSPAGGDEAALAAWAGGTGDALRPAGHREGPARPGAPRYPAGDPGAAVSAVRRQHHDHRRTGGAPGDRRPSPGPGGQHAAAVLRPAGIPRCPGGKRASVPAAAPRPSVAELPWLARAAHPQAGEGSCPRPAGREQPQRQPRSPRPLLPQPVPAHRRGLRRARRPGAGALVGVVPVAPGARQVDRALYRRQARRTGAARGEAPAGDVSGVRCRLHRDPGGNRHARPRAVHQCRRRGPGADSLPQRPPRLGRRPGRDERALGQAALRACS

SEQ ID NO: 30608 - protein, 388 aa, Pseudomonas aeruginosa
RTGACDGKARAARIGRRPGSRPDSVGEDHPHGIAVGTGGDVALGRVDDGPVRHVLRGAATGACLGVAGGPDRRVSRFVEVVLDRVGAAEHSPPAAAEVVAVVEADGIGGVQGAAHANVLVHRGEGRDQRGAAEAEVRSAVDEAVLEHRQGNVDAAAGGAVVVYADWADARRAQVPGPVQADGIGIGAGRQGHPGGGAQVQRQAAVGGVEQAEDAEEGGAAPAYRRADVVDGAAAVVLADTVGQVGAAGGVVQPRRGAQRIGGAGDGRVDGVGAEDRQQAAGALEAGGAGDGLGGAGHGERAQAAEIAGAGAGGAGGEQQRAGAERSEAEQAGGRGVAAHGVSPIGAEQVSGPTWLTVGLRVSRRKRAWQARPSGRTTRSWLSLCNPSK

SEQ ID NO: 30609 - protein, 267 aa, Pseudomonas aeruginosa
HGRGTGPTSASVAGNADRRVVVRQLQFQGHAGVRQQPRRQRPAHLLAGQHVAEQAVQQRQAAAVALPADMAQAGVHATLVAHLQVTLALFLDQPPGQLRPGRVGRVALDIAARLGPDAVGADEQRHRIAHLELQGETGASLRLPRAAVGHFVDQHPIGVLRRAGLAALADQPDQLPAARLDLDEGRAGNHCLLVAIDVLEIRLGPAEHAHLQGHRLLAAILQPQRGGRLVGFDGRVDRPDQHRTGGLCRAAQEQRQQRRKPAAGAER

SEQ ID NO: 30610 - protein, 146 aa, Pseudomonas aeruginosa
RGGWKMDGTAKCSVRCFQCESLCCSSSALFCQPSLPGSNRLRTMATMAHRAMPFRPMSSGPVPLPISTPPMPNTRVTETITRLRASERSTLCRIRVFMPTEAMVPNSRQRMPPITGTGMLCRIAPNLPTKARVMAITAAQVMIFGL

SEQ ID NO: 30611 - protein, 157 aa, Pseudomonas aeruginosa
SWPVTPPTAMTPPICSMAGARPTGTMNRIACQLNSGAVNFGSSSQGAATIAAVSTTPKTNDRAKPTSTPAMIGTRRKIPLPNTATTRVVSSAGIEIIIAVRYGSNSLPSPALPIAMFAAIGAIARPIEMITGPITTGGSSLSMKPVPLIFTARPMKV

SEQ ID NO: 30612 - protein, 214 aa, Pseudomonas aeruginosa
FALDRRGLPDGDRMSTFADFFSAQPGRSTMSVDLAHIRQVMAEADCLFNNDEVEAAIGRVAEAINRDLGETNPVVFCVMNGGLIFSGKLLPLLDFPLELSYLHATRYRNETSGGELFWKAKPEISFIDRDVLIIDDILDEGHTLSAIIDFCKHAGARAVHTAVLVDKEHERKARPDLKASFTGLYCADRYVFGYGMDYKGYWRNAAGIFAVKGL

SEQ ID NO: 30613 - protein, 207 aa, Pseudomonas aeruginosa
RAAWSPASQLPPHGGALPSHGGGPPAEYLHPAAPAPGCGQGRGADRAQGPSRPAGLRRGRGTPRQARVERRWGLPRCRPAARGVPCPGGAGAGQHPVRMQGRALPPARRRRVRQLGACRRQRRCAGLPGLDARPVRLSASLRRRVGSHARVPARPVRRSRCSPVACAAPCSCLSVWPAWPPRIPRCTRASCRPTTASCARRRRSSSN

SEQ ID NO: 30614 - protein, 99 aa, Pseudomonas aeruginosa
EKAMRKDKKQIIGEEISDESIKLFLGVEPADDTPPSLHKLIKAYRGLRIDDFERFLTFFREAGYDLDARDAKGNDFVALVADQRQAVPYIEALQAAKGA

SEQ ID NO: 30615 - protein, 186 aa, Pseudomonas aeruginosa
RLAGGRRAGRAGVGQDLLVALFRYPGGPFRGVLDDQLRGRRLTPQMKKPPEGGLFRSAAHSALTGACTSFFAVSSSTSLQRLLTLRYSSASLSSSFSRAGKISFSLALHSGERACSGKQRSIRPSMIETVTEAPGEAPSRAAMEPSWAATSSVPNCRMPPFFGSFLMICTRWPATSRRQSSALASG

SEQ ID NO: 30616 - protein, 284 aa, Pseudomonas aeruginosa
SGGDYNGENQKIPRSLDFFPIPGHEVPAGESPLGQSAAPYLPNAGHACPAPPATGEEPRPVANVQGNAAVLSRRRYTAGHSCPTHGEMSMLHRLLLSLMTASALVLGGCALSPQQLDPQPVLKGPLTAVGHGQPVVVKVVDGRPGPSLGTRGGLYADTSTLTVRSEDVVPKLQAQAETAVRLLGYTPSANAYNAPQLILTLAELKYQSPKDGVYVTQADITATFRADVQNSSRRYTGRYGASLNQRFGMAPNQATNSKLVSEVLSDALTRVFKDPTIAQTLGQQ

SEQ ID NO: 30617 - protein, 220 aa, Pseudomonas aeruginosa
RFGLHCAAFPHQAVPSMSGRYALFRWNPSLAALPGFPADWRAHWNISPANQVLMVREDAGARRADLARWGLTPAWLTDLSRTPSHARAETLAEQPMFREAFQQRRCLLPANGFYEWRGVRKRPYWVSTGERLLFFAGIWEAYPVQGQTWLSVAQVSQAAAEFRRPLLLDEAEQDTWLAPDTPLPALISLLAKPQPKLRSVALAGFVNKPETDGPECLTPA

SEQ ID NO: 30618 - protein, 327 aa, Pseudomonas aeruginosa
FTRRRCCSARRVSSALACEASSAPPATWLATWPMLATLRLMSSATALCSSAALAIWGFMSLITDTAWVIDSSASAAWRAWRTLSSVRSWLSCMTFTTSRVPCCNCWIMLWISSVACWVFCARLRTSSATTAKPRPCSPARAASMAALRASRLVCSAIPRIATRIALMFSLSLARFCTTPTARPISLARAWIAAELLSTICLPWCAAWSAWLAASAAWVALRATSWAVAVISWTAVATSSISASCCCTPWLVRMAMSAVCSEESLTFCTDCTTWPIMFCSLPRKVLKPLAMEPSSSARSLLRRRVRSPSPWAMSSSMPTNWRSGRAMP

SEQ ID NO: 30619 - protein, 120 aa, Pseudomonas aeruginosa
NIRMRQNTWRMAIGMFFRGFSDSPAAMPISSVPWNEKPAIIATPTIAWKPPTKGASPMVKLLKPGDSTPCMMPKMVARPTPMKITTVTTLIRANQNSLSPKPRAEITLRPNMMPRKIALQ

SEQ ID NO: 30620 - protein, 271 aa, Pseudomonas aeruginosa
ESSAPPGPAVATVAPEATNSPVPMEPPMAIMFRWRGLSTRRNCWPWLAFRSVIGGLPAGGHGRVWLRACGQGEEKLHSQGSRQKSGATGGVDAETVAFGECPAGAEVAFDQRRVLQEAVGDQAQFAARRQVLGGALQQALGGLVVGVHALVEGRVADDRGEFARRAVDAVGGDHFAVQAVGGEGQSAALDSEGVDVEQAQATGGVATLEDRPEYPGTAAEVQQMAAGQGLQLPQQQRAAAIQAAMAEHPRQAHHLQLAIGQRQAVALGQGV

SEQ ID NO: 30621 - protein, 276 aa, Pseudomonas aeruginosa
QGGARVLLPAYARQAGVPGRTGRPGQPPHRQVPPGRLPVDPGSGAGAEHRGRQGTPAGDRGLPRTRADQGNRRWAAGASGGTARAADRKTSAGCRYPGARPAAGRRPAGGQRAERAQPGSGAGLVEPRRGLAAAAIRRLRQPRQPRLALHRPDHPGLRRHRVLPPGLLRADRRTRRDLAVQRCHPLHPVARYVAAGWHVRRRYPADHGFLFEGQPGHSGLGIPLRQRQQEHRRQHFLQPSLHPLALAEPERRPGVAVEGYRDPPARLRQRRLEPRS

SEQ ID NO: 30622 - protein, 136 aa, Pseudomonas aeruginosa
RIPGATAMKRPLILAIALATLTANAAFAAPRVESIALRGAQQLIASDGSDRTLERLRKTQAPRVQEERRVAESGSEQTIDRLHRDMTSREARLAENGSEQTVDRLHKDMGRVDLRLADNGSERTVDRLHREMRRPA

SEQ ID NO: 30623 - protein, 521 aa, Pseudomonas aeruginosa
HRGSRRKVREKPGSMPGFLIAEKVRCSMGRTDNAPGVIADTPLSGQRRATALASVQAVALRQAREQLHPCSGDHQGADPAEDHCRYRAEPMCGEPGLELAELVRGADEQAVHRADPAAHLVGGFELHEGAADDHADHVRGAEYHQHAEGQPERFRQAEGDGCQAEDAHGEEHDPPDVAFDAEVRQPERHRQGAHRWSRAQQAEAPGPGEQDVLGEHREQGGGAAEEHGEQVEGDCPEDVRSAADETDAGEQRVEGGLALGERLVAYRQAERQDAREDVESRGRHVDPGGTERIEQAAEGRGGNGRRLHRRSRSGHRAREQPGRYQVRQQRLGGRHFEGAGGTEGEGEDEDHVAGDLSRSRAEHLCHRHQGLAGLAEGGDSASVVAVGNMPGVEHEQYPREEFDQAYQAQVEDIAGQFVDVPADGHGEHLEAAGGADAGQPEGEEGTMAEQGAGLAGHAGVGRFERRAESNMWLPLGCCHCRNRRFREAHEKVGAGLAGDQSRVSMGPSSGRRDFSSGATCR

SEQ ID NO: 30624 - protein, 891 aa, Pseudomonas aeruginosa
RRLVQGLRQQGVRPRYPRQGHARLAAAARPRHVAEDRSRRPHLRRPRPFLAGRRVAAGPYRHRRRPGEGRHRLPRGAFARSAPAAGQGADVHRPSGGDPDLERLRALPPGQAQAQVQRQGDPLWRPGPAVPGRSLRQLSLRPGRRQDALRGRRVLQPEGLDAVPHHPQPQTGMDQRAEAARRPHRAGAVPCQAHGRATGKPAAGLAGLRRALQDPIDRAGGTGAGQRQRLVRRGEQDLALRGRHPVPVRSRLRKRAHDQAVALRPGEVQHPSGLYRRLRLQGQQHLRLLCRARRAVWRGCAGAPGQRPLRAVPERHQAPPVRHPLPTGGRQERPRLPHLPRRHERRRRRARQLQRLGGGGGRHRRAVDLLHAAERPGGHRLSFARRGGRLDARLRYPADHGRDRDDGRRDRWPAGRRRHRPASSQRPALGHEEHPGRGPGRCPAPARDPRQGRCPRGLEGPRRTQEALRRGRPGQLVWGRLRHLPEGLRHRRRGADGEHRVQRRRAHQPAPHRHRDRYRDVHLAGLRGRRLPRPSGGRGEDRRDRMARAAAHHQGQSLPDEPGRAGRRATRSALGRQAGLAVVGDQLGVLFQPRHPRSRARAVQPRPVAGGPGAVAQRSVRRPGQSLCGAPRKRGMGRRPVDRQRPGADSLHRAGEEGPRDGPGHRRQRPRLQPLELGRGGLRHRWRARAPAARRHGGEVRRRRAGSEEGDDEQRRLPPARPAESGLSGDPAEQRDGHLLQSGGDPGRAEGEQGQRRGAGARPPFLDRVRPGAGAGAGQGSAGGRHRHGYRPCAAGGNAALRGRPRGRGLELQPLPVAAGEGRGGVEPDGGDPPAAVADRPGQGHRRGGDDPGGRRHRQRRGARHRQARPRPAHHSRPHQGGPPWLTASSR

SEQ ID NO: 30625 - protein, 422 aa, Pseudomonas aeruginosa
TRSSRSSSTSSPSSAAIARRASSTPPPCWWKKPSASRSSAASWSRRSRTASAITSAVAPATCATTAPPATCSTNSAWSRRLEDEADPFRPRPGAGRAVAVPGLRRRRRRGAGQARRIPRPRRRLHGLPYRRGRRAVRRRAADPVAVRHHLRHQHHPGQGTRHRRLQRRRVLRRSYRGQAQGRRLPLSGDALHLLSPDRARGCRRHLRLPDGPGADRPAGAADQPELPVQRAHGPGRLEPALRQERALAAGGRAQRGLEARAVHGRGARPLRRVPYPAQPGRRPGAGQAPERRPAQRLPGAQPAARRPCRARLDPAGPGELPQARHERPGQHVQRDVPGGAPQHPAPRRQRPGSHGHLPARRPAAAGQGGPGAARGAAERQRQARSPAVPQRLRRLPRRRRRGQAAYRGGDERQHYPAPARPA

SEQ ID NO: 30626 - protein, 362 aa, Pseudomonas aeruginosa
TRRRVRALARRRCPAPAAGRLFQRRPCLRRVRQGPGLRGDPLRPARRSLARRAAGGHRDPSRAALAVHRRRRLPRRYGGGGVDPRSEDRRPGDARGGAYRSLLYRRDGIAGDLGETLRAPAAHRRPGRCRTGADPRADRPQPRQQDAGGNRPGGAGGHSSHPQRHSPRAALMVAADEVLCLVLAAGQGRRFGSDKRLARLADGTTLLAASVARAREAFAEVRVVVRAGDTPASLGLPAQQRLVHSLDASLGMGHSLAAGVAAARNSTARAIAVLLGDMPWIAADTLERLAAMATPEAIVFPLYDGQRGHPVLFGRAFWDALAQLDGDQGARRVLQAHRPAWCEVPCDDPGVLRDVDTPAALG

SEQ ID NO: 30627 - protein, 142 aa, Pseudomonas aeruginosa
LFSRFQDHELRIRRDLLDPAEQPLELGVVAQVAVADDPQFAARRQGIASLEKHAPGEEVADHLLLVERRVAQDQVQRARRLAGQAIVGAERRRPLAQRRSPVFPRRLHGHVRLIHQGQLGLRVEQRVGDAEHPVAAAQVGGA

SEQ ID NO: 30628 - protein, 373 aa, Pseudomonas aeruginosa
PGSAWTGAFATSSGDRHPTRFPNETRASRRGARRCHRTGTSMFKPFVGVALAALFAVSAVAHAEDAGPIVIKFSHVVSDDTPKGKGALLFKKLAEERLPGKVKVEVYPNSTLFGDADEIEALRANKVQMLATSLSKFEPYTKQLQVFDLPFLFDDLEALKRFQKRDKSRELLRSMAKHGIYGLAYWNNGMKQLSATRELHRPDDAKGLVFRIQPSSVLEAQFAMLGATAKQLSYAETLKAMQAGSVQGTENTWSNLAGQKIDSVQPYITETNHGALSYMLITSSAFWTGIPYQTRTELESIVDEVTLVVNKEAEALNQKEREHLLAAGKSRLVSLSAEEHEAWRNAMKPLWKNYEAQIGSDVLRAAQVVNRKR

SEQ ID NO: 30629 - protein, 229 aa, Pseudomonas aeruginosa
QRLRHGPGQGGRGRSAARPATGGEAPGLIATGAAIQAALPLSVWWEMTTMRGWILAGLLLAALAAQAGEVHGVEVEARLRDYFFDAARRGDQAMLKEFVEAGFDLDVQDAKGYTGLILAAYHGHGGAVEQLLEAGADPCVQDARGNTALMGAIFKGEVRIARRLIGAQCSPDQRNGAGQTAAMYAALFEREELLQALSARGADLGARDALGNSVESLRRGELNGTAAAR

SEQ ID NO: 30630 - protein, 656 aa, Pseudomonas aeruginosa
KRAPPAPFFMWACSEGAAETETLSDRDETQAHQGDRGDVPAQLRQALGVQVRDQAQARMHAQGGGRRQEQQLELQGTGHRRGAEPVVERQPQAGQPQAADHLQQQGGDADPLVDLLEGADRLGIAAAQGAGEDAEGQDQVAADPDRGTQQVQEQQCAHGSLLVRPSVSREARSIEADRNQASGYHLRFARERSSHGQGQAHVRLHRVWRDLPEMGWPVRGLRGLEHPGGDRRRGRAERLRPRRLGRPAGQPEDPGGGQRRGNAALHDRLHRTGPGSRRRPGGRFGGADRRRSRHRQVDHSPADPLQPGQPRPGAVRHRRGIPAAGGDARAAPVVAGRQAQGDDRDQHRNHHRHRAPGAAAGDGDRLDPDHLHRAVAIGAGWRRPGPRERRDAGALCQAERHGDLSGRPRDQGRRPGRPAGARTHGRHRTVFRGRIRRPPAPAAGGEEPLRRGQRTGSVRHDRQRPEGSEQPFGDLPHAGPGSGARQRGDGHLGRLAADAGGGPGAGRHQSPGESAAGDPGPRPEPPGDAAGGAAPARRYPDLRPGRVPQRGGWGQGAGNRLRPGVDGGGDVQPAQPPAAARPAGVRRGRAVRRGASGAERPGAPEGSRQAWFQACHRTPRQRAEGGAGGIAGDRRDAPRAGPGRPLRVTRLSRRGR

SEQ ID NO: 30631 - protein, 704 aa, Pseudomonas aeruginosa
NFRCRTAPSICRKPNTMNNNNSLLRHLAWLVVAIVGAAALGVVALRRGEAINALWIVVAAVAIYLVAYRYYSLFIASKVMQLDPNRATPAVLNNDGLDYVPTNKHILFGHHFAAIAGAGPLVGPVLAAQMGYLPGTLWLIAGVVLAGAVQDFMVLFISSRRNGRSLGELVREEMGQVAGTIALFGAFLIMIIILAVLALIVVKALADSPWGMFTVLATIPIALFMGVYMRFIRPGRIGEISIIGVFLLLGSIWLGGQVAASPEWAPHFTFSGIQITWMLIGYGAVASVLPVWLLLAPRDYLSTFLKIGTIIGLAIGILIVMPELKMPALTQFTDGTGPVWKGSLFPFLFITIACGAVSGFHALISSGTTPKLLNREPDARYIGYGGMLMESFVAIMAMVAASVIEPGIYFAMNSPPAVVGADVNAVAATVSSWGFAITPEQLTQTAQDIGETTILARAGGAPTLAVGIAHILHQVLPGENTMAFWYHFAILFEALFILTAVDAGTRAGRFMLQDLLGNFVPALKKTESWTANIIGTGGCVALWGWLLYQGVVDPLGGINTLWPLFGISNQMLAGIALMLATVVLIKMKRQQYVWVTILPAAWLLICTTTAGLIKIFDSNPAVGFVALGEKYATALDAGQVLAPAKDIGQMQHVVLNAYINAGLTVLFLLVVFSVLFYAIKVGIAAWGKSERTDKETPFEPIPDA

SEQ ID NO: 30632 - protein, 83 aa, Pseudomonas aeruginosa
PAALPGSPGSLNEELAMFNDLSRMGKYLGQAARMLVGMPDYDTYVEHMRNKHPDKPVMTYEEFFRERQEARYGGGKGRPIRCC

SEQ ID NO: 30633 - protein, 158 aa, Pseudomonas aeruginosa
SCSSATTCRRTVSARASNASSKAAEAHRRQRSVEMDRNALIGAWRDCIRGADKSWVLFAQGTCVILTQPEPDLAAQARALLAEWGAVQVGTPAGDFGVITLDNGRGWVVTGHHPDILTFVPREELEEDAGELLVGMHGRSRRGEDAEALAVIHVEDRR

SEQ ID NO: 30634 - protein, 254 aa, Pseudomonas aeruginosa
SKNFESCRAAYFRGHGRRDLHCALVYNSRQIQPSSFMSDTDVRGLQDLPLEELVACHECDLLMRREPLGPGEKANCPRCGFELAAHRHQWKRRCFALVLTALFLYIPANFLPIMNLSLLGQTRSDTVWTGVLGLYDSGMQGVAILVFLCSMVIPLVKLLCQLLVMISVRFGIARHIGMLLYRGYHHLREWGMLEVYLMGILVSIVKLIDMADLSLGIGLACFVALLFTQVWLEVTMSPHQVWEALGGEDDDARA

SEQ ID NO: 30635 - protein, 795 aa, Pseudomonas aeruginosa
AGSRRTSATGCCPASGIRRGARAVARRCASRRPRPWPRRRAAAGWPAGRGAGPAGTARMAFAGASPCAGARAWRRRRSIQANVAFEAEGLAGLTQVGRGQFRWVQFGERLQRRIGLHPLAHRVLGGLAEDRLLAFLAEHEGDELLGFPGVLAGLEHCGAGDGDQRARVLVAEVVQARVQLALFLLQGVPVVVVDQRHVDLAVLHGFHGGDVVGVDRAEGIQAGQPILGFLLALELDHGGDLFEEGATGGHEAETAGPGRIGKIHQALRQILLVDLLRVVGQYPGAGGDADPVAVAAGVLRLDQGQGLWLQLGQQAGAGQADQRWRFLGVEHVGRRARAFLGDLAGELAIAALADLHLDAGLVLEGLGDGDTGGGVLAIVEGKGDGIGRRIEGKRTEQARQGGVAETVEKSNRHGFSPWVTNANVTNYIFAGASGLSEKSTALSGRAVADASRRFAGFLRLAGCAGFAAGGGIPATDVFPVRFVDINAVRAATAFQVDRHVCGNLRLHARQDRHEAQLQAGLQQRGLVALVDVRRLVQVVGQAHAPGLLAVHQVQQQVHVGQRLDGHGGAVGGGAVDVGVHDRLAVDLGDLEGQFEQVLQAQLVVVGGDQAGQVFLGLLVLRVLLGALGQVEHREVLAFLVLAGAVDDLVDVLERILVRREDDAEALQVGNLALVDLAVEQGQLVFQVVVVAADVAQGPGDVGDRRAARLGQRQGLVLAMRVGVDQQLQAALGVVFAIELGDALQAHLGVQRLDLPVDALQRLPGVLVVVEQRQQVVQRVVHRLHERRAEGQVGRQ

SEQ ID NO: 30636 - protein, 436 aa, Pseudomonas aeruginosa
KAVHLAAQYVALGHAVGQGFHQRAGGDQRLVVLLHPPHVAEGLLAGGDVVDITRAQAVLEGVEEQLLELGRGDLAHVQQVDEQRAEGLQALLAGGAQRDHGQVERDRRVPADQQAAQLFRLHLVGLEAFALKVGEQLALAQAGTVLLVVVQAQLAGVGEELVAEAAARAAPGHADHVRTVGQHQFEEDVAGVRGEVEAPRLLHAVLAEAHVRQAGKDRELQGVDRGALAQVVGAVDRQRVFQREDTQAVAGGIEQGEAADAVAGLAHASASCCACSSAMARARASSSLSSDNSSSLAISGSISPSSTSTGVCNGRSACRLADRLRSCCTDRQTSRKRCIGGMKRYTPLSSEAKPSWVRRRMTFSSSSSWVCTSAWRNRSRYFSSSGGSSSRPMLPPSSTDSGSRPWSARCSTRMKVNSARRWAVLFTWAPTCSGTK

SEQ ID NO: 30637 - protein, 136 aa, Pseudomonas aeruginosa
PAGSSARRTRPRSPGPPRSAAPGESAGRWSWPARPRRSVPARHCRASSVHRARACRAVAAGAPGPGCRGSRRRPGCTRRGAPDGAGRPRSPGTDQGDARGAGRRGSRGSARSARNGWGSWPPGPGYPGGSTGRAGR

SEQ ID NO: 30638 - protein, 234 aa, Pseudomonas aeruginosa
GLSCPAWSGEWGFQGLARFLLKSPGLSIPNECRLLNDAAYAEARWAELQNQGDLAWDLDAITNRSEAIAFLKRFENRLCIYSAYVEKLYSNYSFVIPESDHGGITILPSEQAWHDTFHDIPLAAVEPTGIHILPGETMGYRGLYLKIPGEHRLVASKELPFQEGLKLLIQRYQAHDDVFLPILVKGDLREYEARMPSLHLHRINPARLSAHSLLSLNAIKGAIADHLIGLFRQQ

SEQ ID NO: 30639 - protein, 366 aa, Pseudomonas aeruginosa
LQVAVSLPSATRRTRGEPMSRRLPFLLRCALFCGAGLLAATAQARMESLDDDQLSDVVGQAFINLTTDAANGLNFTRINFGADIETQLNMKKLQLGQYNRSGELAGSADIAIDNFALGTVNDATGAINPFLISNPYIEFAYDGSKMVGIRIGFGEAKGYLSGDIKTLTGNVPVDLYGTGSQLGGSISCGLLALDCLAAKTAITLTGSSQYTAQAELVNSSGNPDPIRAAMIGLKNGTALDMHDSTIIGSLVNVLLPFLTSNDCKLMGAQTCFNLAQYQSFPIGTVDPNNAQNFIDSSKGFFISMQSQNVQWRDQQDPSKLVAALAGAFLNMSRNADGTAPIKVDFGQAFNGIPRQDTCLGGLNKGC

SEQ ID NO: 30640 - protein, 152 aa, Pseudomonas aeruginosa
PVGCPASRCRSPHPRGRSCWRPRPGKSRRCLCVRAPRSMRRRPASRKPRRRPARRAWLPPRPWKAGGSRSACRSRAPRRRRKPSRSRRSKRPRPSRRRSRPRRRASPCNCCRRAPAPCWSNCPPANPSPAAIRVTCCCATCCAPPACRTARG

SEQ ID NO: 30641 - protein, 217 aa, Pseudomonas aeruginosa
AMARRPLNRSLPPLIDCAARRSWSSWLWKPLRAPSSVLKRVSPPTPFLVTMLMIPPVAPPPYTALAPDITSMRSMLNGSMESNCRLMPRELFSDTPSIITSTLRPRRFWPLLVRPWEPISRPGINCPNASFSGTPAWVCWSSCSRSITQTVPGNSLILVGAREPITTICCSTGSAASAGAENEAKRDRESARGAGRKGMERGMRRFPSCCCFDGRQS

SEQ ID NO: 30642 - protein, 92 aa, Pseudomonas aeruginosa
MILTFRCDETRQLFETGLSRRWGAILTVATRKLAMLHAGTELRDLRSPPGNRLEPLQGKRAGQHSIRINDQWRVCFVWTDAGPEEVEIVDYH

SEQ ID NO: 30643 - protein, 285 aa, Pseudomonas aeruginosa
PARITRFRPGSSRPRDSRNMSFSSPSSSSAISASILLHTGTTTAPSSSAMAFTTSRCGLFSKPSSATLAMYITGLLVSRWKLRTRRFSSSPRFFSSERAGLPSVKWGMSFSSRAFWARASLSPPLALRATFCSCFSQLSRSAKISSRSMISMSRLGSTLLDTWITLSSSKQRTTWAMASVSRMLARNLLPRPSPLEAPATRPAMSTNSMVVGSTRSGLTISARAFRRASGIGTMPLFGSMVQNGKFSAAIPDLVRALNRVDLPTLGRPTMPQLNPMLCPSRSDRR

SEQ ID NO: 30644 - protein, 204 aa, Pseudomonas aeruginosa
KSGSGLLAVQLLHRPGPVPGEHFRQHAEGEVDAGVEQFLLAARCAAEHVTGNQAAVPRMADAKPQAMERILIAELGDDVAQPVVPAVSAAGLELGDARGHVEFVVGHQDGVRGDPEESRQRRYGLAAAVHVGGRDQQTNVLALVAELADQAEILAVSHEADALGMRQALNEKGPRVMPGLVVFRTRVSQANDQLYGRHDGSPSL

SEQ ID NO: 30645 - protein, 179 aa, Pseudomonas aeruginosa
QSFRLSPSRTVRTLMAGESRVNSGSEKISAVLTSTCGTTTRYQGSGMSTGVSFSPTPSAKAARPRVKTGTSAPRRRPRAAMRSSSQPSCQRWFKARSVVAASELPPPMPPPMGKRLSSQMSTPCGLPEASCSPRAARTIRLLSCGTPAISVCRRTWPSWRASKCSSSPWSRNWNSVCNS

SEQ ID NO: 30646 - protein, 341 aa, Pseudomonas aeruginosa
AVRQAQGGRDGRRRSCLWGQYIGNGCPALGEVGELRVSPISSAILHGLHCPRHQSQDRLGGCPRARGFHSGTDGRGAAAALPPDHQPRGGHPVDLQPERTLPGDRPSDRGRRARLAGGLPSPDSRRVARLCLCAPGRRRGAPHDARGLRPRLDGPRRAADPRPDEVGLRRRARGRHRRSAARPPVPGHLQYGEDRPHRYRHRREPGVRGVRRGEPGQADLQRPAPQPGAADRRRRDHHPGRAPPVRARREAHRGGQPHPGARQPARRAVRRPCGAAFGDTRGVGQQRYRHQLHCQPVADPRQGRRGARAEAAQAQADVHGRHRRAARHRAGSRRTGRRLPL

SEQ ID NO: 30647 - protein, 433 aa, Pseudomonas aeruginosa
GAGQGPAATGQRCRPRRGDGPAGPRPDQQTAARAQRADEENVRRGPHRRAGPGPGAVRPRRGRAAPLTGTYACMKASLLKKLDVLSDRYEELTALLGDAEVISDQTRFRAYSREYAEVEPVILAFRDYRKVQADLEGAQALLKDSDPELRDLAEEEVAEARGRLAALGDSLQRMLLPKDPNDSRNVFLEIRAGTGGDEAAIFSGDLFRMYSRYAERQGWRVETLSENEGEHGGYKEVIARVEGDNVYAKLKFESGAHRVQRVPETESQGRIHTSACTVAVLPEPDEQAAIEINPADLRVDTYRSSGAGGQHVNKTDSAVRITHIPSGIVVECQEERSQHKNRAKAMAWLAAKLNDQQQAAAQQAIASTRKLLVGSGDRSERIRTYNFPQGRVTDHRINLTLYSLGEVMEGAVEQVIEPLLQEYQADQLAALGD

SEQ ID NO: 30648 - protein, 209 aa, Pseudomonas aeruginosa
HDHYLYPSQGFPTARFAQRPARHRVAAGGGDGQAAQLPAYLAGAHRAARGQRAVRRLDRPSAQRRAGGLHTWPPGLLEPGPGGRATHPDPAPGHRTAGGNRAGDPRGGYRYGARPGHRHRRHRPGPGQRTAAVDGDCGGPRGRGRGAGRAQSPAVAPGERRGAPQPLVLRSRWPTLPDDRRQSAVYPCQRSAPERGRRAFRAEERAGRG

SEQ ID NO: 30649 - protein, 287 aa, Pseudomonas aeruginosa
SRGGGARTARRPRLRRGTYVARPRRQRADHSRTMGMLSDEELLRYSRQILLAQVDVEGQLRLKRSRALIVGLGGLGSPVALYLAAAGVGELHLADFDTVDLTNLQRQVIHDGTSVGVGKVESAMRRLGALNPQIRLVSHSAALDKDSLDAAVAAVDLVLDCTDNFATREAVNVACVRAGKPLVSGAAIRLEGQLSVFDTRRDESPCYHCLYGHGSEAELTCSEAGVIGPLVGLVGSLQALEALKLLAGFGEPLVGRLLLVDALGTRFRELRVRRDPSCAVCGQRHGG

SEQ ID NO: 30650 - protein, 217 aa, Pseudomonas aeruginosa
FPSGAGRQGSGTGLQYRDGCGCGGIARTLSAGAAGGHGACGEAGRGGHPQRSGRRPGHHRNSEERAFRRLARPLRQRRTGLHPALPGAGRAHRSRRSLWAANPGTAGTPAGAHPRTGLRYADPRLYSLSLRQTPAGRADPGGDGGDRYGSGCRPAAGARIVGAGATGLWPGRDAAFLDQRAAGGDGKDPADPLGKPGKRRKISRLVVPGRRVSDFLN

SEQ ID NO: 30651 - protein, 309 aa, Pseudomonas aeruginosa
RQGFEGFALDLHGRSDQHHRAAHPCQQARQVLRIEAMTGVQQHAASFQAFAGQGQFGRWQRPVEDLQRHLAAAEQPAAQPEVRFQRQLGLVDQQQRRALLQPLLVIKAGAQLAAQPGEEEGPLHARAELSLPASFEVLQQGLQKLFAEGRYRIERRGLVEQIVEASLGQRGDGVQQLFVQAFPGGFDIRRRGFLRTLQQRAHLADGDATLEPDEYPADALDLLFAVEPVPLAGALRHHQAIAALPGAQGDRMDAGQTSDFADRQAAAFEVGRVHREILERVAQAEFGRVRLQVGLLGDVCMRVATEVVL

SEQ ID NO: 30652 - protein, 134 aa, Pseudomonas aeruginosa
RHAAMPVLLDQLAQFTPVFGCEVAFQVAAQVQQHVAMAAAGRAAAQALHQLAEVASAEGFRLVVAGFAEQAAEAAVVLRRMGQQLVLVAAMEGDDGRMAEAALAQGLPVGMGIHAGEEVLPQDRIVQPAFFFHR

SEQ ID NO: 30653 - protein, 423 aa, Pseudomonas aeruginosa
CVRSQPGAQPRFRQGPGPGAAQAGADTDPRVRPAPRAGRNVRIAARRPASLAATLAGRRLPFSIHRPGRGAGRCPGRPTKGSGMTENALLLLNLGSPDSTRVEDVRRYLDQFLMDPYVVDLPWPLRRLLVSLILIKRPAESAHAYSSIWWDEGSPLIVLSRRLQEAMKPHWPHGPVELAMRYGQPAIEKVLLDLARRGIRRVTLAPLYPQFADSTTTTAEQEVRRVIAAHRLGLEVSTLPPFYDQPVYLDALVESVRPYLQQPHDHLLLSFHGLPERHIRKLVKDPAHDLLAENSRNVSPEALALCYRSQCLRTAEAFAERAGLEQGRWSVSFQSRLGRAKWIEPYTDAKLDELVQRGVKRLLVMCPAFVADCIETLEEIGMRGREQFISAGGEDLVLIPCLNDHPAWVGALAEMSGRLARPL

SEQ ID NO: 30654 - protein, 486 aa, Pseudomonas aeruginosa
ARMLPAYPACRPSLRIRRFGGVQDFGMHNNNNGYPSNLAAWTTVAILMVAYVLSFIDRQILNLLVGPIRRDLAISDTEMSLLMGLSFALFYTLCGIPLGRMADNRSRRGLILFGVLVWSAMTAACGLAAQLMAIPHLPGRRRGRRGGAVASGLFADRRQLPARASGDGDQRLLDGHLPGLGAGLPARRAGDQVRLGPGRRASAAVRRGAPVATDLPHPRRRRRALLPVAAGYPRAGPARSRRRRGGAAGRGRRLPAGQPQDRALPQLRFRLPVLRRLRQRRLGADLLRPHPRLGRRSCRGGLRQHRRGVRLSRHRLRRAPGRLLGEARAQRREHARRAARRLGGDSLHPGLSAAGQRQLGGGADGADGVLPEHAVRRGPGGDPGDHAQLDARPGLGDLPVRGHPVRSRLGPDGGGAGHRFRLRRRHGAALLAAAGDPGRGAWCGGPAGDRPQALSRQPGAPEGLEPATGRRGRRGLEGVPAAGLTQ

SEQ ID NO: 30655 - protein, 261 aa, Pseudomonas aeruginosa
SAASAPARRRRRTASARLTAPGARAAPGRHRPCSGFLLLGTEDLVAGVAQARNDVAVLVELLVDRGGIDDHVRVGLAYRLDALGGGDQHHGADFLAAGLLQQVDGGDHRATGGEHRVDDQRAALGDVRRQFFQVGACFQGLFVAGDADRADLGAGNQAEHAVEHADAGAQDRHHGDLLPGDLLHRHRAGPSGDFVLFQGQVLGRLVGQQGADFLGQFAEVLGADIGTAHQAQFVADEGVADLMYGHGRLSPTGAGKKIALA

SEQ ID NO: 30656 - protein, 240 aa, Pseudomonas aeruginosa
SSTTSSTKGTPSRRSSTSASMPAHARCTPPYWWTRNTSARPGLTSRPASLASTVPTATCSATAWTTRATGATPRASSRSRGSEMAGPRYLDQQLFAELASGAGNAPRGRQHHNFHRMEEPCHRMAVGLQPNTYIPPHRHLDAGKAEALIVLKGRLGLLVFAEDGELLDKRELSAAGDCPGVDLPPGVFHALVVLEPDSILFECKAGPYRPLGEGEFASWAPAEGSADAPAYRDWMRAQFA

SEQ ID NO: 30657 - protein, 164 aa, Pseudomonas aeruginosa
PVRLPAPVCQSGRPGRRESPDARALPAARRRPVAPGGAGAAATDPDHRVQRGAGQPAAVQPAADPDHHADPAAPEGQTAEQGRDPGPGADPVRQRRQEPEEAGLRCRDPHPHAQLPVGAVPGVARPAAQPDGLLPVPRLSQRPCLGGPAHRRGTRALSLAARRE

SEQ ID NO: 30658 - protein, 186 aa, Pseudomonas aeruginosa
TPRGPRRGRGSPGRRGRANGQDCVIRSARGCLSAVAFLHSQEKQPAEVPMYVQPYVCFNGRCEEALRFYEHAIGARVSFLFRFDEAPGPVVVPEGWCDKVMHANLQIGDSQIMASDGHGPALQPISGISLSLNTRDPQQARRCYDALLEDGGRVELELGKTFWSPCFGTLVDRFGVSWMINCEAGA

SEQ ID NO: 30659 - protein, 103 aa, Pseudomonas aeruginosa
PRRVVLLRRLSMSLQALWALFLAHPAQAVNGLALFFGVAGAWLLLATRARERRALARWAAEGEAGEAALPMDEATLRINLFFYRFGTACLGLALLVSWASTRL

SEQ ID NO: 30660 - protein, 88 aa, Pseudomonas aeruginosa
LMQRVYEPADLLEAEMLVGMLASEGIAAHVSGRHLVGAIGELPPGGLLALLVADEQTERARELILAYNAAAPLAEEPPEPCGPGSLLC

SEQ ID NO: 30661 - protein, 349 aa, Pseudomonas aeruginosa
PLLELSLRSLSAGGRQILNRPSEISSPTAVAGVRGAAYHALGLQRRTKDHGSSLPIRHPRRRAAARRLPGSEHHQWRRRRRRPQAIHVQHVVQPGSRPDVRPVVPEDSRRGEKRRRARYQQRRRAASQGDRPAADPADRRLPPGRHRLELGSQCGEERRAQRQLRSRRQDHFLHRADRQAEAHRRRDSRGDGPRDRPRPARAWARGHVQGLRRAGGQPDRRPGRPRPGKPATGQYRRRLPDDPAQQSCQRERSRPDRSRAGRPRRLQPGSGDHPLAEDGQGQRRRQPARVHQHPPLRQFADGQSPGRDSQGDAAVPAGQARQVRPGRAVAGGGRRADRLTIGNACCVFP

SEQ ID NO: 30662 - protein, 362 aa, Pseudomonas aeruginosa
PAVWYLAGVRPRLLADPLAGPVDEQPLSRPGAHVKYAVLGATGLLGHHAARAIRAAGHDLVLIHRPSSQIQRLAYLEPECRVAEMLDHAGLERALRGLDGVIFSAGYYPSRPRRWQEEVASALGQTNPFYAACLQARVPRILYVGSAYAMPRHPQGLPGHEGLFYDSLPSGKSSYVLCKWALDEQAREQARYGLPVVIGIPGMVLGELDIGPTTGRVITAIGNGEMTHYVAGQRNVIDAAEAGRGLLMALERGRIGERYLLTGHNLEMADLTRRIAELLGQPAPQPMSMAMARALATLGRLRYRVSGQLPLLDETAIEVMAGGQFLDGRKAREELGFFSTTALDDTLLRAIDWFRDNGYFNA

SEQ ID NO: 30663 - protein, 259 aa, Pseudomonas aeruginosa
DGAHSAQAGRLGQVRDGNFRPGGRRGSLIARKRAGIRSDPRGIAGRQGESGIGRADVHFVVANEACALLPAVSQPDRQEQRQADIGGEEADPVDAFAHQRLVVLPEGDDHAQGEGEQRAEGEQLGPVGQVFQAAALGQVTLAEAIVGDGDAQPGDEAAHARSVQQPCVDGAVAEGRSEEAQGADQGSGVQRVAWHAAARDAGEQARCLALEGEVVEHPGRGVHAGVAGGEDRREDHRVHHPRPPGGSRRARRAGRRAIR

SEQ ID NO: 30664 - protein, 74 aa, Pseudomonas aeruginosa
CPGRSRSSRCPAPRGTRNSSPVALPPAPRRWSPPSCTSSSSRGRNRSHLRRTGCHRCRTSRKRACRPPSRRDWS

SEQ ID NO: 30665 - protein, 328 aa, Pseudomonas aeruginosa
SVSSRDLGRNRTAEVQAPVGARVSKRLRSGKRASNCACSPACQLQPWACGSSASRSSAGRPASSSGVAKRWRWRSSTSLRGSMRAPEKMGNLNRLGPGIPAWIVGEDRRSSVRGARSAVSAGVDYPQGAPGLPCLCVFRQLADDALPRLATAPGVMGGDDQARDVGGQQRIAVSRRFDAEHVGSGAAQVAAAQGVGQRLFVDQAATGGIDQEGARLHQRQFGGAEHPAGVLGQRAVQGQGVYPWQEFAKRQAVRPGRPSWQLTEQHAHAERLRQPRHRPAQFAMAEQAEGLAFQFDDGEVQQAELAGLLPATAAYRLLVVRQARSQGQ

SEQ ID NO: 30666 - protein, 291 aa, Pseudomonas aeruginosa
KAFFWHTRRNVNCFSDFRHLTDEMQCWKTDVRHADREIFMVRPDSQRGKRTSSKAGREGRFVLAASSTLMFAIASINAAMAAPTGAQFNPNEIKISQQGKTTLIDQSTQRAIINWKGFDVSADEAVRFNQPGVTSSTLNRVTARPGKCDRRAHLRARPGDHLQLQRRGIQRLGQGRRGLPDHHHGEHQRRTLPPGQADLRPARKPRRADRQRRQHQRRGERPGGLRRAVRGQQRRDQRPSRHRGDGRRQRRDHRPLRRWPGVHRRDRPGYPQAAGCPGAGQQRRRDPGRRR

SEQ ID NO: 30667 - protein, 203 aa, Pseudomonas aeruginosa
RADHRRAGFPGGRQRGQPVRRDPRPRYRGARGQRGAGKQVRGHPGRRQDRRQRSEERRRRAGQRAAGGPGEHRQHRRPRRRTGRQRAHRRRLPGPRRAATSEERYAGQGRQHRRLGYRQGQWRPGGGLVRRQYPHGRADPRARRRPGRQRRPGGDLRQGQPEHRRQRLRQRRRTLRQRWHLAARPDHPAHRRIRRHLRFGGGR

SEQ ID NO: 30668 - protein, 241 aa, Pseudomonas aeruginosa
HRPGFLGQLRRQPGAADLQRYAQVPAEQRHRRDHERHGVRSVHQPEHDRHRAEHRLQRRYADSRGQQRRHHRQLHADRRRQQRVRPPGVHRAALSAGQRFRQLPDQRLVGLPGDQPALPGQRQQRHRHPERRCAQRVHRRRRQRQRHHLDRKLGHQLGRQGLRRRDRRDRRAAVRRRHRPDRGTDLRPRRQDQPRRYPPGPVHARGSVQQLRRARPGGDVQDHHHCRRHPFPPADRHPDRQ

SEQ ID NO: 30669 - protein, 179 aa, Pseudomonas aeruginosa
RQWQRVFQPALPTGAPGRQADRHAGAIDRQRRRQDQGLWRRRSDPYLPGQWPEEQRYRRWRAERQPRPGGRGERRQLRDTPGRAGPQHGQLHPQLRRQRPAHHPGTTERDRRCQDQGLRRPGSGADLPGLRSQARRYRRCRAQRWQPEPRGWRERRRVRHQPGWTGPGQQQLHPELPGQ

SEQ ID NO: 30670 - protein, 569 aa, Pseudomonas aeruginosa
MMKHSQWTLPWVTLCGCGMLAASAAAVELPGTVQPSQLDERFKPRSEPQAKPEAPLVVPKQVAPQGSEQIRFELREIRIEGNTRYDKAVLESYYQHMLGKQVSLAELVDLANRLTAKYRQDGYLLTQVVVPEQSIEGGKVRLQVIEGYLEHVQIKGTVDGPRVRVEELLAPLTEKRPLDADTLERGLLLVGDLPGVNVQSVLSPGQALGSSNLDVALQQQRYEGFVSLDNRGSHYTDPTTLAFGATEFSRLGFYEQIDVLGAISPFSDATRYIQLRGTLPLGGMFAGDTLQIMGSYSKVNPDIPDSVFPFDSVSKSTEGSISYNHPFIRSRSQNLSGGLALQWKDTETRLRDFASDASNPGRDHVRVFQQRLTYDWVDRWMGINLAEVRNNIGLDMWGATKKDDERRSREVADGRFVYLNGNIGRLQGLGGPWSVYGELQWQYSFDPLLPSERFGVGGSGIGRGFAPGNITGDRGFALKLEPRYGQAVGYSWLRSYQAYAFYDWGKTYNLDVDDDEQQKLGSIGAGVRFNLTDQLSFNPEIARQVIGEPADQRDGKRETRVLFNVVARF

SEQ ID NO: 30671 - protein, 328 aa, Pseudomonas aeruginosa
PAARRAWPRTAANRPSTVCTRTWGASICAWPTTVASAPSTACIGRCGAPPDTADHAARCEKSPARCRAFLLPRRCGVPWGGRITPQALSPIRRCRGSDARRHWPQCRRSRCARLGNSFIHAPVTTRVPIPPRTTAGTVPNQCAVSPDSNSPSWFEAPMNRPFTALTRPRISSGVSSCTKAPRMTMLTMSAAPSTTSTPRDSQNDFDRPKAMVARPKMPTERNMIRPTLRSMLKCASQNDIARAPTAGAERSRPRPQGPVSRMSLANTGSRAVAPPRSTANRSREIAPKMSGRLRMKRMPASSESRVALPWVSGWLRTGRLSVRTHART

SEQ ID NO: 30672 - protein, 957 aa, Pseudomonas aeruginosa
ITTWVGTVPPRGTCMSNRDISRRAFLQGGLIAGVGVTLAPLGSQAFAALFENQVTVSAQRWMAGNGQVRFRNDALSKVCGNKVFARDIRARDMPGWPQQQGHAMLLKTVRADRIYEGHDLSWLGAELQPDRIVTAADLEKDGIVFPEAHSPDPLLPPGKVPMFIGHPVAILIWNDFERFRRAKLKLKFNDKAIRYGAQAPLYQGDPYGSYRFVRVGGKTPYEDDEFSSLKDSMLFPTILNRKPVWTSEPKLHGDLTEQGLFHAKRMAEQLENPPQDWLVFDERYKTPSIEPAALEPDNGNGWYDAASKTLHFVVATQCPFEVAYESVHMIKPSRFALEKFNIHPGYTVGYGSKDNNIFVFYAALAALYGEGVPVRLANDRYEQFQSGIKRHPFDIRYQLAVDRNDLGFRIFRADMSADGGGRANYSASVAAVGATAAQSIYYMPQNDLAVTAYHSRGVEAGSMRGYGTLQTMAATEMMVDEIAGRLGVDAIDLRRRNALRSGMKNTQGAVPAGALRLHEILDKAAAHEVWKDRDARKKRFDAEDPDNWYGVGFAICQKDFGTGAEAPMASIEFSADGRISLRHIGTEIGTGMSTSQAFVVGDFLGRPADEVKTAETEWPELRLTTKGNPYLMSQAEQDAALRDPRWVGKLASPSSATNSAFYFSHATREAARVLFNHGLWPAALELWRSGPFGGQANPYVVRRENAVWVDGQLTGNGLAPIPFTELAKKAHEMGLVTGVSVHGFNRWSWAEADFVIDGVRERLPLDAMAVKYGDGAPGVKKAMMNSAGFHLLDRQNPAYPATQLNNAMVTYYSPVATLVELKVNKGSGEVQVLDHHSWIECGRVLVPELVKGQLEGGIAMGIGHALLEEMPLYEGGPAEGDWNFNRYRLPRAKDVAAWSQTAEILPPLSPTDPAKGIAEVVMIPVVGAIANAVAHATGKRVRDLPITPARIKEALHG

SEQ ID NO: 30673 - protein, 593 aa, Pseudomonas aeruginosa
PQAPDDPQRSSRRSGGGRRRPADDRLPARIPEPHRLAPGLWPGHLPCLRGDRRQSGRHQRGSAHLHHRRALLRRQEGSHHRGPCPARREWRHPRAEPDPAEVRRPVRLPVQLLRAGLRQRRHRAGGKSPAPADQAQRAGAGDRGQPRPSHLPLHRLRALLQRHPRRARRTRPGQGGLRMKRTLSGLALALAALSPFLASAAGADAALVKRGEYLARAADCMACHTAEGGAPFAGGLPIQSPFGTIYGTNITPDKEHGIGAYSADEFFAALTEGKRKDGAYLYPAMPYTSYHLIEREDADAIYAYLMAQEPIARPAPQTSLSFPFNVRMGLAGWNLLYGKSVRLQPEEGRSEAWKRGQYMVEVLGHCGECHTPRNLAGALEQDKRLSGGLLNGYLAPSLLPGDLAARGWTQPDLASFLKHGMSAQGSMFNEMFPVVHHSTQHLDDSDLAAMATYLLGDQPPPAKVVQALPEAQLNDSGKRGRQQYLNVCAGCHGGEGEGKPHIAVAMNGNTTLRLQDPRNLLRVIEDGIVEQQFTGFERMQPMPGFAGKLDDEQLTDLLNYLRQTWGGLPGDLGPQQVAQLKMESASAHTVKVK

SEQ ID NO: 30674 - protein, 324 aa, Pseudomonas aeruginosa
IVQHLDLQVVRKALKWSVGGERVWFCTVLTTYGSAPRAPGSLLAVNASGEWIGSLSGGCVEDDFLERVAAGGFPDPAVIVRYGEGDDPNSNIRLPCGGILDVLVENLAPDCDVQAHLRELESALLGQRRLLREVELGSGARSLRDDSSHGPRAERDGECVRLRVGAAQRLLLAGYSSVAHACAEFGKGLGFEVILCDPREEALRGVLLEGIEIRRELPSLFIADGGCHADTAVVALTHDPKIDDLAMLEAVRTEAFYIGVMGSRATSEKRFERLRRIGGLGDAELARIHAPIGLNLGSKTPAEIALAVLADILRIRNGIPRERL

SEQ ID NO: 30675 - protein, 89 aa, Pseudomonas aeruginosa
SSFPPLASCTGRTMPRAWSSVSSRRRCWKRSSPCSAPPPSSCPTPRPSRPCRPAACRAPRTPGRTSPDRRSTACSRTSPRPITARSATC

SEQ ID NO: 30676 - protein, 320 aa, Pseudomonas aeruginosa
SRCGRTTRRRSVVTCCARPRWSTASADRPLAIPVSGDSHKPCGCFCRVLCGTLGEYRYPERTMTASEEKFTRQTLLDVQPLTPNLFTLRTSRDAGFRFRAGQFARLGVYKPSGSIVWRAYSMVSAPHDEFLDFFSIVVPDGEFTSELSRLREGDQLLVDRQAFGFLTLDRFVDGRDLWLLATGTGVAPFVSILQDFEVWERFESIKLVYSVRESKELAYRELIAGLAEREYLAEHAHKLQFIPVVTREQVPGCLNGRITTLIENGDLERAADLELTPEHSRVMLCGNPQMIEDTRAVLKARGMNLSLTRRPGQVAVENYW

SEQ ID NO: 30677 - protein, 520 aa, Pseudomonas aeruginosa
QAIRSSSMNPSLNAFRPGRLLVAASLTASLLSLSVQAATLTRDNGAPVGDNQNSQTAGPNGSVLLQDVQLLQKLQRFDRERIPERVVHARGTGAHGEFVASADISDLSMAKVFRKGEKTPVFVRFSAVVHGNHSPETLRDPRGFATKFYTADGNWDLVGNNFPTFFIRDAIKFPDMVHAFKPDPRSNLDDDSRRFDFFSHVPEATRTLTLLYSNEGTPASYREMDGNSVHAYKLVNARGEVHYVKFHWKSLQGQKNLDPKQVAEVQGRDYSHMTNDLVSAIRKGDFPKWDLYIQVLKPEDLAKFDFDPLDATKIWPGIPERKIGQMVLNRNVDNFFQETEQVAMAPSNLVPGIEPSEDRLLQGRLFAYADTQMYRVGANGLGLPVNRPRSEVNTVNQDGALNAGHSTSGVNYQPSRLDPREEQASARYVRTPLSGTTQQAKIQREQNFKQTGELFRSYGKKDQADLIASLGGALAITDDESKYIMLSYFYKADSDYGTGLAKVAGADLQRVRQLAAKLQD

SEQ ID NO: 30678 - protein, 534 aa, Pseudomonas aeruginosa
TCSKARIAWGSRRRRAPGRMPRARTRWPPTQIAAPSRCRNSSVRMEVSLSGHQCRAKRGRSRLIGIKPAAIICALPARGVPMAKAKRMYGCTECGATFPKWAGQCADCGAWNTLVETVVEAAPSGSGRGGWAGQQANLKTLAEVSVEEMPRFTTGSTELDRVLGGGLVDGSVVLIGGDPGIGKSTILLQTLCNLASRVPALYVTGEESQQQVAMRARRLSLPEDKLKVMTETSIETIIATARQEQPRVMVIDSIQTIFTEQLQSAPGGVAQVRESAAMLVRYAKQSGTAIFLVGHVTKEGALAGPRVLEHMVDTVLYFEGESDGRLRLLRAVKNRFGAVNELGVFGMTDKGLKEVSNPSAIFLTRAQEAVPGSVVMATWEGSRPMLVEVQALVDTSHLANPRRVTLGLDQNRLAMLLAVLHRHGGIPTYDQDVFLNVVGGVKVLETASDLALMAAVMSSLRNRPLPHDLLVFGEVGLSGEVRPVPSGQERLKEAGKHGFKRAIVPLGNAPKEAPAGLQVIAVTRLEQALDALFE

SEQ ID NO: 30679 - protein, 248 aa, Pseudomonas aeruginosa
DADRRPVARRRAGAGDDAVQRLRLLLDQHRPGKGPVPPAGAPRQRRDRLRPPGDRVHRPGRSGAGGADLLRRRGTLPALRAGRHHHPGGRRQRRASPAGNHRPGPGRLRRPHPGEQDRPGRRRHLRGPGPAPATDQPEGAGACGRARPHRPGAPARRTWLQPQRRPRSWHRPAPAASGGSQGQPRSHRHPGTAQRHAARSRKAERVHGRPVAVAWQFPAALQGRAEHRRRAASPGVPGRAATLRLRLG

SEQ ID NO: 30680 - protein, 220 aa, Pseudomonas aeruginosa
PRRRTAPGSGRRQRRPGRRRGPCRRTGRRRPCRRWRGSGRNRGPGNRRRSRRRSSSACAPRPGARLRRSRSGHWRRCRTAQRCTACRRRRRWRRGSGGRHGPGSCRGWCRRPTAGPGRPRRWPGSRRAAGRWRNRRRTVAWRGRWPVARRYRRTRSRRSSACADNLRRTCWSAPNPGLPSPPGWCSSRRRSARCALPGAGLPAPSRQRVRHRSGRGSNHG

SEQ ID NO: 30681 - protein, 942 aa, Pseudomonas aeruginosa
GSVLGKGAHSNPCGGCWHMKGHHVADKRRSSAPHGGSALVEHEQHVAGVEHAELLGGHRPAEQVALHLVAAVLAKEVQLGLALHALGDHHQVQAVGHGNDRPGDLCVLFAVGQAVDEAAVDLQHVDGELLEVVQRGVAGAEVVHRDGQAEALEPGEDLHGLGDVAHQDAFGQFQLQACRRDACLVEDRGDPLAQLAIGELPCREVHRDLWHPHLGLVPAAQLLAGFRQQPVADLGHQADLLQHRNELARRNQSAARMLPAQQGLGAGQAAAVAGELRLVVEDELAQFKGAAQVAFQFQALQGASVHLGLVELEVVLAHLLGVVHRRVGVLHQQAQFGAVLGRQGHADAGGDEEFTAFQGERPGQTAEDQLGDLDRPFQGDLAVALGRQQQGEFVAAHARHGIVLADAGAQAGRHFLQHAVAGGVAEGVVDRLEAVEVEEHQHHPLAVALGLLQGGMQTVLEQRAVGQVGEGVVVGQAVDAPLAGLALADVAEEADEADQVAFLVTHRGDADPGRIEFAGLALLQDLAFPAAAVLQAGEHVLELVGFLAVGGEQARLLVEHVGRAVAGQAREGIVDLDDVAGRVGDHDRRRGVFEYRRRHPQLAFGAALLADVAGDAEQAFEAVVLVPHQDDPQFDGNLASVGAQAVEGEQMLARVFPQLGELLAVADGVPHAAQQAVQAAELARVGGGLMEAVEQRPFRAVAEHVLYRGADVAGVEFGVGGEDHVADVFRQHAVASAVLAQRVVRLDGEGDVLGHADQARHATAAVAAEGLLADVEPVPAAVAVAPAQLAVEQQAVADHVLQVADAPVVFLVVGVQQGFPEVLAHPRQFFLVVAQLLAQVMVAEDHPARVQVVDVEGIGHRLDRVRPELLALDQRQFDFLATGDVGQAEGHRMPFAGVFRQAQLQPQVPRRALAAAQRGFQFEYRPAFDERLDHLQAQAVRL

SEQ ID NO: 30682 - protein, 503 aa, Pseudomonas aeruginosa
RAVVEQALPGLFGGLDLQQAATDIVDLGDADPLQQRLLPPGFAGEPGAQCGAAVQALFHQSLAQGGEVEHAEGHADPFEDVLVAPPGFLQDAEGVLFLGDVAQHPDLPALEYLLAEGPGLVGERRIAGQRMAAEGERPRLAAHPQRQQLATGLAVATGVRQPAWLEVRQQAQQMMLAGLGRTDAEEAFGLGIEVAEAAVGAGHQHPLVDRRQCRGRLAQAALRGQGHGAQALLLAVQAQQHVHGDADQQEEDRQLAADSRQQAEPHSRAVVEPAKLPVAVAQRFHAEGLHVVEQRRAPRGMPEHPPGVLVFQAPEQVAGGQVGTPLGEAVAGQVQQPEATVAAAAGFAQGQVEGFAVARVEAIVVEAGAGVLAQLLGQRRFRRRAVRLQGAVHPLQLAHLRQRIADARQQPALYLATLAGGHAREQGEGGARLEFEGQGQAVVETIELGRGSLVFEAFLLAQLLAHLPEQQAEHQQDQQQQASLGCRSVGYGQWVAGGRRRRG

SEQ ID NO: 30683 - protein, 716 aa, Pseudomonas aeruginosa
PGHSRRPGCGAAGGEDRAEAGWCPGASPVTCAATVRAGSPRGFSDVRILHQAAELRLGGGPVHLPGRPAGHFQIAGSAVPQCRAATDHHHRHLSRRLGEGAGGLRHQCARGVAERRQGPALLRVDQQLQRHRRDRRHLRAGHRSGPGPGGRAEPPEESRGAHAAGGADPGPAGRADQRRFPADLCAQLQGRRSAQRHHRPRRLRRAQYQQRAAAPAGRRQAAILLFRGGHAGLDRSAKAGGLRPLHRRREQCHPRAERAGAGRRLRQRTGQFRAGADGDPGGEGHPGRSAGVRPGSAARQPGRLAGPARRCRAPGTRQGELQHFLATERHAHRGRGDPAVARGQRDPDRYPGETASRRTVGVLPRGHAVQRALRHLAVCRRGHREGDPHPDRSDGPGVPGDVPVPAERPLHPDPVHRGAGVPAGYTDVDVPAGVLGEHDDHVRHGPGDRHPGGRRHRGGGERRADHGGGGDFPGRGHGQGDEAGIRRHRRHHPGALGGVPAAGFHGRFGGGDLPAVFGVAGGLDPVLRLPRPDLHPGAVRYAAQAHSRRAPREARLLRRLQPWLRPRHRALFAAQLEAGGARRTLHAGVRRPGGDARLLLPAPAGSLRAGGRPRLHGGRRATAAWCFARAHRCHRRGARALPQVPRGGGFGVPDLGLQLLRPGRQCRAGLPDLQGLVRARRRAVGRRRDRRAERAFRAARRWHGHGRVAATDQRSG

SEQ ID NO: 30684 - protein, 319 aa, Pseudomonas aeruginosa
PARRRHRGRAPALPADHHDFHGVHPRRDTPGPGQRCRRGEPACHRHRSDRRDAQRHLPRRAVRTYLFRLAAVAAAQQAGTHRTGRFGRGVNEMRKPAFGVSALLIALTLGACSMAPTYKRPAAPVAHSWIGAAAQRQGTAIDTLDWKTFIVDAELRRLVDLALNNNRSLRQTLLYIEAARSQYRIHRADRVPGLNAAATGNRHRQPVYLSAGNRSEVAHNYQVGLALPEYELDLFGRVKSLTDATLQQYLANEEASRAARIALVAEVSQAYLIYDGALRGLGLNRQTLVIQQVIPSPWIEHPPPGPAPATALGLPRNPL

SEQ ID NO: 30685 - protein, 88 aa, Pseudomonas aeruginosa
PDRRGPVRTPAGPARPGSCEPLPSDCRRTGRPAADGGCRWQRRSGPEPGRRGGFDTASGPPRYTGGFGATSGCYSGPGPPGGVVRHRR

SEQ ID NO: 30686 - protein, 317 aa, Pseudomonas aeruginosa
KSSNPACRSPCPGAGRRRRSSCGPPARRDVCRSAPWSRRRGSGRSAAPIRRMQVCASRSLPGRSGLFDGCRLAAQQRQQPDETDRYEQHAEEGGAEHPADHSGADGTLARRAGTAGQGQGYHAEDERHGSHDDRPEAQARGLDGGVAQAMPLLPEFLGELDDEDRVLRRKTDDGDQADLEIHVVGHTADHHREHRADGADRHDQHHRQRDRPALVERHQQQEHHQDGEGEQAGGLPGGDLLLIGQAGPLVADAGRQLRGQALHFRHGFAGAEAGRGVTDDADRRVAVIAHQLHRSLFPFHADEGAERYQVASSVRHV

SEQ ID NO: 30687 - protein, 740 aa, Pseudomonas aeruginosa
QAQLRRFGQSFHHRVKEFRVGLDLAKKSIASLQQRFAADPGTVHQAQCEAAGVTQTVDRWRRHGHDRAIVGQREMLVQRGDLGGGRLLGASLGPVLEGREGQRGIVALAGEAEARDQEHRSHRLAGLEEALELLAGGIGAHARSTRRQLHVDHHVAEVFRRHEGFRQAQVEVAEHRHQAGVHQHEASGARHQLRVEQRIALGDAGEATVEGAEEAALLVVPFGNGLEQRSAQRRGEGQGEEAGEQDRDRQRHRKLLVDHPHRTGHESQRQEHRREHQGDADDGAGYLLHRLDRGLGRGNPLLRHDPLDVLHHHDGVVHQDADRQDHAEHGHHVHREPQQVHQHQCTQQAHRHHDGRDQGVTDVLQEQEHPQEHQDHRFDQGVDHLLDGHVYKPRGVVGHAVLHVLGEERRQFGETLFHQGSGLDRVGPGRQLDRPAHGGRAVQSRGNVVALLAEFQARDIGEPDQRAVLVGAQHYLAELLRIVQGALHRQGRRQLLRGTARCAAEGAGRHLHVLPADGIAHVVDGEAEAHQLLRIDPDPHGRLGREELQLADARQAPQLVVDIARGVVAEGGGVAALSAFLVAERIDQQETGAGLLDLQALGQHRLRHARLGFLQAVLHVHLGQVRIGARLEGDDDLGGAVGVVGRLEVEQALGAVQRLLEHTGDGVHQHLRRGAGIGGGDGDLWRRDIGVLRYRQFGNDQQAGQGDEQGHHPGEVRPLDEEFGHRKILGANPPLLLRRR

SEQ ID NO: 30688 - protein, 386 aa, Pseudomonas aeruginosa
LGLRLGTIRLRHDLHPRLHRSQAADYDPVTRLQALGDLPARTLHDAGTDAARLGALVGAHHHHLGAAVAGAVHGPLRHQDRLVVDALGRTYAHVHARQQDPVGVGELAAQGDLAGTAIHRHVGELQRALALVGRPFDAQGQRLAVAGGQGAFLQGVAQAQGLGRGLGEIRIDRIELLDARHQRRLALPDQRALGHQRAADAPGDRRSDRGVAEVQARGLQVGLGRAGRRLGAAQVGGGGIEVLLADRLDLHQRLVATHPRLRLEQHRAVPRQLTLGARHRSLQRCRIDLEQQVASLDVGALLEALPHDDAGHPRAHLGDTHRFDPPRQFRTQRQGLGLHRQDLHRQHHFGGLLSLFRRPTTRQRDGHSQRPDPSYCTQISHDTPDR

SEQ ID NO: 30689 - protein, 621 aa, Pseudomonas aeruginosa
RATHQGAGSRYRRPPASDAEGTGRGGRRKQGHPAPLLRHAGQPGANARGPRRDRTEPDHPDLRPGACRASGGVAAPDQGTPHPPRAAGIPGIPVPPGLPRPARGRRTLAVLPGSAGRLLPARTAERRVSHRHHGGRVHRTVHHPGLRHGRCGTSRTGGQLQFRAYPGADVPPWRLQSGALLTLAPAAAPLSSPHGTDRSACRRLRPPGGLLDTREDQSSPVLRQSASTAGKDRDARRRYWHLALLPGILTVYRITPPPGIPVSVDPLANPVAASRRRPTDRTRPTGSQGWPAVAGPVDARPAALADEPGAAPAGTLRTRASRGPARSSQRPPVPDPRTQGAHRPRPAPGRAPQRAWRDTGQAVAAHQRCAAAGAPVAMGGQRPADGQPVAGNDAARAVAPARRLRPLPLLPRPARRRIPLPDPARTRQPPRQWLLAVAPGQRQPRPVESRPAHRQPALAPGRPIRRAGALAYPGEHGAARRHADPRRGTAAQQRLAASRALRQHASAARPAAGNRRRAGDLPPAGRRHRVHAAAPAPRATGPARHDPGLAAQPAPGGHGTGGDRRAGAGDPRRRPPQLPQSPGRTPLRHQFGPGPPASSAGPAAGPRARLADGRRWRRRDP

SEQ ID NO: 30690 - protein, 588 aa, Pseudomonas aeruginosa
RAAAAAGARRAADVHPQPPSAGQLSGARRPGLDPPRADTPGRAGLGVARRHRGTARPRRPGGNPAALPGHLRRGRRGPLRARPLRPAPGSGGTRPGQLRRTARLARRRTRAAAGAAGADPHHRDQRCQSPPAADRVHRTGLAALARPRPATTGQPAPAGDRGAHRTPAGTRTGSHAALRQEHAAAPVVATAPAGKPRRMACGAPQPVRRHQSQGSRTVADRAREVLVGRGPGGARYPLHPRPARAPGDLQQPSPGPAVGLQPGRTGADGRELLGNPAAPRRPGILLAHPQPAARGRRRPAARQPTALAPPRRPLALVRHPRAGLQPRPQRSRGAPDRRGQGHHLHRRGEQRAARERPTLPHAGGKHQRRDLLHRRRTQRQLRQPLGTARVRLQPGMGAAQRPPSDRHQPAPARPPERPAAPRAARHRRPPEARRAAGKPWPASVRPRLPARRRTQDSHRTADRPDVGRARPLRRPARHRPRHQPAAPRRTRAADGGDGIRTLHGGDHGHRPGRLHRPGQRFLLAPDRLQPGRRARPAAAPAHRRPPGSQPAQARARQPAAQRQLGRRDPAEAQDRRTLSVLGRHHRGA

SEQ ID NO: 30691 - protein, 276 aa, Pseudomonas aeruginosa
TGRVRPPLPAAVHRRRPPPDRRRGPAALAASAPRTGSAERVHSGAGGDRPGGPGRRLAAGGSLQAVAQLAQGQGAGAKGLGEPLGTAVRRWPVGRADRRDPLRDRHPAGMPGAGTDRKHPDERRRRGHADPLRAQAPRPGHRGGRLRHRLLLAELPQAVPHRRAEDRPQLRRRPAPRRTGRTDRPGDHCHGPQPEPDGDRRGRGEPGPAGLPSRARLRRGARLPVRPADARRAVRHALRQRRAVHVQRGLSRRAARLSAACPRHDGLSCASTRRMG

SEQ ID NO: 30692 - protein, 431 aa, Pseudomonas aeruginosa
NARLFPAPILMRTAMFSRDLTLARYDAELFAAMEQEAQRQEEHIELIASENYTSPAVMEAQGSVLTNKYAEGYPHKRYYGGCEYVDIVEQLAIDRAKQLFGADYANVQPHAGSQANAAVYLALLSAGDTILGMSLAHGGHLTHGASVSSSGKLYNAVQYGIDANGLIDYDEVERLAVEHKPKMIVAGFSAYSQVLDFARFRAIADKVGAYLFVDMAHVAGLVAAGVYPNPVPFADVVTTTTHKTLRGPRGGLILARANEEIEKKLNSAVFPGAQGGPLEHVIAAKAVCFKEALQPEFKTYQQQVLKNAQTMAQVFLDRGFDVVSGGTQNHLFLLSLIKQDITGKDADAALGRAFITVNKNSVPNDPRSPFVTSGLRIGTPAVTTRGFKEAECRELAGWICDILENMGDESVVDGVREKVKAICAKFPVYGN

SEQ ID NO: 30693 - protein, 454 aa, Pseudomonas aeruginosa
CPVTTQPRPLSRVITPKSPAGVPTCTAPHSASNARAWAARSGSGCVRITQVPWANSTQDLSAPRMQSRQAPINAFLSISTLLWRRCASAAFDDAFEALADTVLRQVVADEHDHALARLVVPPLAIPVEAVESQHALEHQATRLVGDVQHALVAQQGIAMPLQQVVHELAQPFEIERRVAAQYQGADAIAAVLGCHRSQRAQADARTEVGVEVEATYVEQVRQVDAAVLDHMHQRPPVDPLQALAQGLEGGGVDQVGLAHQDAVGEADLGLGDGFLQVTLGVGGVHQGDDAVQHVALAEFLVGEEGLRHRRRIGQAGALDHQAVEVDLAVVAALQQEEQGLFQVGVDRAADAAVGQRHHLHRLDAEQLAVDRRLTVLVLDHRDLHAVLGLQQVLEQGGLAGAEEAGEHGDGDRGVVVVGYFGHAQLPEKTRATSDVARGRMGIQQQRIGRPLPPP

SEQ ID NO: 30694 - protein, 248 aa, Pseudomonas aeruginosa
AFSTTCCIWPISLAGASTWPASSAVAYFSPRATKPTAGLLSKILIRPAVVVQISNQAAGRMVTQTYCWRFILIRTTVASISAMPASIWLEMPNSGHRVLIPPSGSTTPWYSSQPHSATQPPVPMMLAVHDSVFFSAGTKLPSRSCSMKRPARVPASTAVRMNKASKRIAKWYQKAMVFSPGSTWWRMCAIPTARVGAPPARARMVVSPMSWAVWVSCSGVMAKPQLLTVAATALTSAPTTAGGLFMAK

SEQ ID NO: 30695 - protein, 161 aa, Pseudomonas aeruginosa
PARRTSTFPPDRLRRRQRDPPGRTALGGLAPRRLPARHPGRPAAGLERRPATALRGPPVPGPGCTDPHGDQPGLGSRRPARLRMPAHRPRLHQPPAPPGGTEPGRRGTPRARAGPAGQRPRRLRRVTRRGRPGPARGASRRSPAIPPAPPSARCRGVRWHA

SEQ ID NO: 30696 - protein, 159 aa, Pseudomonas aeruginosa
RSACRYATSRSPRARPPSTRCSPASVSSAADRTSSGQSPSTCSPCSSAAPPPCSRCSPRTSCSPGPGASACCARLQRWAPWRCRSGWRTSASNATSGGSCSSPWASSAWQPSPSACRNRSGCPSACWWYSAPRTWSAWSSAAPSCSSKPPTRCAAGSAR

SEQ ID NO: 30697 - protein, 222 aa, Pseudomonas aeruginosa
SCSLAWRNATACTEANAVARRCPDSGVSAITPGALSVLPMEHRTFSAIRKPGIEPGFSRTLRRDPRCQAGRRISRCRRSTVRSLPLSARRRSTRPMSLCRRSTVCSLPFSARRASRLVMSRCKRSMVCSLPLSATRRSSWTRGAWVLRRRSRVRSEPSEAISCWAPRRAMDSTRGAAKAALAVRVARAMARISGRFMAVAPGIRYVGPFSVRETRLENEARQ

SEQ ID NO: 30698 - protein, 985 aa, Pseudomonas aeruginosa
CALRKGLEIQRLVEAAPVVGQVALVRATRPTLGLCSERTIGELPHPLGAGVLRRTRGGSRQQVRIADVHAQSVGAQERVFEERVFQRGGAVDRIPGGIRIAPLLQFAQVGERCQLPQVARRDRQRQDAQQVALVVELVVAAGEGKPTLEDVVLAYGFAAHPTEPAGEHLTGAIAILQAGNLIGQRRVGGADLLALGIGEYVEQRLGDGQVITLVGQVIVATGQHQAALVDAIHTHVLACVAVQPAGQDRAGAVTVLQAADLVGQARVSVAIDLGLAVGDHIEQRLGDGQVVALVSQVIVTADQTQATLLNRIVAYVFAGDTNQAAAIEHRASGIAILQAADLVGQARVGIAIDLGLGIGDHIEQCLGDGQVIALVAQVVVTAVQCQVALVDAIHTHVLACGAVQPTGQDRTGGITVLQAADLIGQARVSVAIDLGLGIGDHIEQCLGDGQVIALVSQVIVTADQTQATLLNRIVAYVFAGDTNQAAAIEHRASGIAILQAADLVGQARVGIAVDLGLGVGDHIQQRLGDGQVIALVAQVVVTAVQCQVALVDAVHADILASHAAQAATVEHRASGITVLQAADLVGQARIGIAVDLGLGVGDHIEQCLGDGQVIALVAQVVVTAVQCQVALVDAIHTHVLACVAVQPAGQDRAGAVTVPQAADLVGQARVSVAIDLGLAVGDHIEQRLGDGQVVALVSQVIVTADQAQSTLVDAVHADILASHAAQAATVEHRASGIAVLQATDLVGQARIGIAVDLGLAVGDHIQQCLGDGQVVALVAQIVVAAVQCQVALVDAIHTHVLACGAVQPAGQDRTGAVAVLQAADLVGQARISVAIDLGLAVGDHIEQRLGDGQVVALVSQVIVTADQTQATLLNRIVAYVFAGDTNQAAAIEHRASGIAILQAADLVGQARVGIAVNLGLGVGDHIQQRLGDGQVIALVAQVVVTAVQCQVALVDAVHADILASHAAHAATVEHRASGITVLQAA

SEQ ID NO: 30699 - protein, 945 aa, Pseudomonas aeruginosa
AVLGDGQVVALVAQLVVTAVQCQVALVDAIHTHVLACGAVQPAGQDRTGAVAVLQAADLVGQARVGIAVDLGLGIGDHIQQCLGDGQVVALVSQVIVTADQTQATLLNRIVAYVFAGDTNQAAAIEHRASGIAILQAADLVGQARVGIAIDLGLGVGDHIQQRLGDGQVVALVAQIVVAAVQCQVALVDAVHADILASHAAQAAAVEHRASGIAILQAADLVGQARIGIAVDLGLGVGDHIEQRLGDGQVIALVAQVVVRADQAQSTLVDAVHADILASHAAQATAVEHGTGGIAVLQPGHLVGQCRIGIAIDLGLGIGDHIEQCLGDGQVIALVVQGVIAADQAQSTLVDAVHADVLASHAAQAATVEHGTGGIAALETGDLVGQRRIQVAVDLGLGIGDHVQLCRGDAQVVADVAEGVIGRVEAQPALEYPVVADVLPGHPAEVAAQHASGGIAVLQATDLVGKGRIGVAIDLGLGVGADDQLRRRDGQLAVLAHQLVTLAEILAAIGVTGDRVLPDVRRLGRRGAGGRLVEVVELAVDVGVDGVDAGHRGRQSRIHITVDAGSVIGGQGGGLLAGKDVAGSGGGLEHLHLGALGEAVERSLAHEQVQAGIDAAGLAAEAEDQFLGQAGADVVLQLVGHADHAAEALDAPTGAPVSGPGGDAAVAGGDGEPAGRTAVRGGGDVAAVDLVAQVGHQVVRRVVGREAGGTADPPIGQRGEHQAVELAVAVGGQRVVAGGADAVGLENPRTDAGDDVLRGAGHALVDERIEHRAARGHAGGVALPVLERTVEGLQRQVAGVVVPGSQVDATGAAGEVGGDQCGTGLLADLAGGAGLHPQGAAAQVDDAAGLRRAAAEEADVAAGADCQAAVAEQDRRRDIHRTGRSGGDQLQAATGAAQVAGDQRRFHRQPVAGAEGHLAACQRPGNHRGIHRRVAAGAVSAPHRT

SEQ ID NO: 30700 - protein, 301 aa, Pseudomonas aeruginosa
ARQPPVRCRQGTVHEPCPARRFPRPCLPRPRRPGHAPPARRLRRAATACRQPTAGSRRAAARCAGRDQQQGADRRAMHRRLPRAGTDPGQRYRHQQHRSRCRSRARYRRRQLPWLRHALGSPAHPRAATGPGYAPAGLPAGGTQRSLAAIQPVLPAGLPHRRTGRQDPRPARPWRTGRGGGAAGGGVRHARAARSVARTACPGGPPAAWRTPATGRRPDPALPADRGHPRDARRRRTGADEAWRLPGQYRPWRPGRRTGAGRRPARRPPGRRRYRRAQRRTAEKRQSAAGPRHPAPDRHPP

SEQ ID NO: 30701 - protein, 310 aa, Pseudomonas aeruginosa
SFSSPCPHARSQTLPWPPAGRPPMTDLNASQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFSLLF

SEQ ID NO: 30702 - protein, 314 aa, Pseudomonas aeruginosa
RAGFPPAAGGDERGDPLGDPLRRQLRHVRLDPDALQPRPRGQGTAPVLPRLAQRRATQRAVRHYPGRRPVLPHFGLRRQHRLHMAAEHFGHVRLHRLAGHRHLPLSLPQGLPGPGRPPGRPALPGQAVPLRPAVRLRPVHGHHPRAELPGAGGRTHRLDRPPRHLYQPAAVPGDLAGIPLEEARTLRSLPRNGRQPDQYLTHPAAQRFLADRCGCRHVSLRSGSLAALPDESFRPGLAQAARLGQNAPRPRGVVSRERRTGLARHASTHLVRRPWRARPKPAQTGQGFDKTYDTHDLTRGGQMARVMVIGRPAP

SEQ ID NO: 30703 - protein, 734 aa, Pseudomonas aeruginosa
GFAVLLPISSSETIPTRVRSPIMKLKSIQFSVAALAGASVLSVVVVLVLYALFAGARTQELVQQRTQGLLEKVINERLVALARAQVSQIQRELEYPLTVVHGLANSTRLLGEPGADGMPQLNASRDEISALLRSTVQNNPKLLDTFMAWEPNAFDTDAAFAGQPGKGYGPDGRYLPWWYRGADGKPIVEAMADSIDSEKLLPTGVRENEFYACPKENKRPCIIDPAPYEMGGKTVMMSSFNVPIMVGDQFRGAVGADLSLAFIQDLLKRADQQLYDGAGEMALIASNGRLVAYTRDDSKLGEPAGSVLDGNEVDNLKNLTVDQPLYDIDAEHGHIELFLPFTIADSGVRWTLMLQIPQAAVFGELQQLQGELSDQRQQDILGMSLAGLVVAALGLLVVWLVGYGIARPLRQLVGMLDDIAQGEGDLTRRLSSERADELGSIAKGFNTFLGKLQNMIGQVVQSVQKVSDSSEHTADIAIRTNQGVQQQLAEIELVATAVHEMTATAQDVARNATHAAEAANHADQAAHQGKQIVESSSAAIQALASEIGRAVGVVQNLAKDSENINAILVAIRGIAEQTNLLALNAAIEAARAGEQGRGFAVVADEVRNLAQKTQQATEEIQSMIQQLQQGTRDVVKVMQDSQERTDDSVRHARQAAEALESITQAVSVINDMNPQIASAAEEQSAVAEDINRNVANIGQVANQVAGGADEASQASAELTRLAEQQRRLVNQFRV

SEQ ID NO: 30704 - protein, 299 aa, Pseudomonas aeruginosa
NMDWKVFLLRVAVALVLGALIGAERQLRQRLTGLRTNALVSTGACLFVLMTQGVPGLGRRRFADRRLRGLRDRLPRRRRDHARRPQRARHEHRSHPLVHRRHRRPVQHGPAAGGHARQPGGALRQHPVARHRPTPEPPGRVAGQRGRATLRSADRLPRRGRDPGSQPDAAQPRQQRPAPAIAAQRGSGQPGQAGSPRRTARHPRSSGAAGTPGQPGQPGEGRQLGALAGLRTGGRLSGGRLNTTGCRGRRAPAAPRPAGRRRCRRGSVLAPAPSARPPPTTPAVRQAAVRRWRRPGGGR

SEQ ID NO: 30705 - protein, 420 aa, Pseudomonas aeruginosa
RRSPRGIATPPERRRLPRRPGPLPLPAPGRSPRLAAQTSYSPSPGPRGHRHPQRRHAAGQVRALRRPHHREGHRWRHLLRGQSPQARAAPYLFIANHRDIVMDPAFVNYAVYHAGLPTPRIAIGDNLLQKSFVSDLMRLNKSFIVHRSLSGRREKLAAYQTLSAYINHSIREDRQSVWIAQAEGRAKDGDDRTDSAILKMFHMSRKDEPFAEMVRALHFIPVSISYEYDPCDLAKARELHTRASTGEYRKAPGEDDASIAWASPVQGPLHINFGPRWGEFSSQAAGRRTGPADPRQLPSVPGALPGLRDEREPRPGPRRPHGREPVRQRGAGEGAQGMEPPPGAMPGRAAPLAGAAIRQPGAQPIPDQAAILKTKARRRRASPSGNGFEPAGDGRITAIRLSACGSARRGRALRAACWPS

SEQ ID NO: 30706 - protein, 538 aa, Pseudomonas aeruginosa
RLPPPLPAGPYRPRPRPVCRQFGAEDFGEALMAQNDHETVDMLLVGAGIMSATLAVLLKELDPNLKMEVVELQESGAIESSNPWNNAGTGHAGLCELNYTPQSADGSIDIKKAVGINTMFEVSKQFWSHLVAKGTFGSPKTFINPVPHLSFVRGSEGIAYLKKRFESLTKHHAFETMVYSEDKATLAEWMPLMMPGRPADEAIAATRVEGGTDVNFGALTNQLLQHLAEQPGAQIRYNQKVTHLRRADNGWRVTVKDTRNGGDREIQARFVFLGAGGGALPLLQLSGIPEGKGFGGFPVSGQWLRCDNPEIVKQHQAKVYSQAEVGSPPMSVPHLDTRVVDGKKSLLFGPYAGFSTKFLRHGSFLDLPLSVRPGNILPMLSVARDNMDLTRYLIGQVMQSPEQRLEALRKFYPEARAEDWRLEVAGQRVQIIKKDPKKGGILQFGTELVAAHDGSIAALLGASPGASVTVSIMLGLIERCFPEQARSPEWSAKLKEIFPAREKELESDAELYRSVSSRCSEVLELTAKNDVQAPVNAE

SEQ ID NO: 30707 - protein, 636 aa, Pseudomonas aeruginosa
DPPPPHPPQTGPDAPCRYQHQELPRTGPGSRRPADLRGDQGPAPGTVRNPRMGRPGDGGEDLREEDHRGADPARRHRHARRRAQPDSRRQGQRGRRRPQRRDPGSTHLPGKTGAGHRRAPLADHRPDARHRWLDGRHHRPAEEGRQQGNPRHGAGRRPRGHRGGTQGPPGRDHLYRLDRREARRERLHHSGPGRRRRQDLRYQAEGSLNMGDAFQEPLWRQVLSGAQMLFVAFGALVLMPLITGLDPNVALFTAGLGTLLFQLVTGRQVPVFLASSFAFITPIILAKGQFGLAATMGGVVAAGFVYTFMGLAVKIKGTGFIDKLLPPVVIGPVIISIGLAMAPIAANMAMGKAGDGSELLPYRTAMMISMPALLTTLVVAVFGKGIFRLVPIIAGVLVGFALSFVFGVVDTAAIVAAPWLELPKFTAPEFNWQAILFIVPVGLAPAIEHIGGVIAVGGVTGQDYLKKPGLHRTLLGDGLATSAAGLFGGPPNTTYAEVTGAVMLTKNYNPKIMTWAAVIAITLAFVGKFGAILQSIPVPVMGGILCLLFGTIASVGMNTLIRHKVDLSEARNLVIVSVTLVFGIGGVLIGSGTGPDDIGLKGIALCAIVAIVLNLLLPGNDGWQNKALDEQHKDSH

SEQ ID NO: 30708 - protein, 231 aa, Pseudomonas aeruginosa
GRSFKVVGTLFIRQHRPASPTFVIDRKLEMNKRTPAVLLFCACASLLGTAQAAGTLIGQVGVQMVIGAGCTIINGSVSGGINQWGTLDFGSHSDLTNVVDAQTVGTSGNIQIQCSTGLTPSLTVQRRLARQRRATLHAEHHHHQQHHRLQHLFGSRAQARLIQANTPGGHFLRSPPGTAVKIPPIRRGGAHRAKHAHADGGDVHGHPAWSPSPGKTRRQARRRAAWSWGDR

SEQ ID NO: 30709 - protein, 168 aa, Pseudomonas aeruginosa
TASLAGGLLCLLGCNPANAQTATIVLSATLLPACEAGSVGSGGAITFGTLDFGQYASLNNAISATSQQGAGSIRVKCVSGQTYAITLDGGLYGSVATRRMANIANTALTLTYNLYSDRPGGIVWDNTTGVAATGNGNDQWYPIYGLVPAQTTPVAGTYRDTVNVTISW

SEQ ID NO: 30710 - protein, 812 aa, Pseudomonas aeruginosa
NCNWRTTTRRSAFPATEADVGPVPRPCQRRSRHHRSLLIGLALLSPVHAADYLAGLPPPQPAPSGGSNVLYYLELVINGRDSGQVVPVNAADGHYLLDAAALREAGVRLPGNPAGQVAVDALPEVRADYDSASQQLHLQVPPDWLPEQRFDDPGLVARAPARSSLGALFNYDLYYSDPADGATPWLSALLEQRLFDGFGVISNTGVYTRYFGDADNLDSRYLRYDTYWLYNDERNMHSYQLGDYVNGALNWTTPVRMGGFRFARNFGVRPDLVTYPLLRFDGQAAVPSTVDLFINGYKASSADLQPGPFAISNVPYINGAGEATVVTTDAQGRQVVTSLPFYVSNTLLARGLSDFDLSVGRLRDDYGLRNFSYADNAVSGIYRYGVSDRLTLSTHAEAASDLRLLGIGGDIAVATFGTLSLAASGSDGQGDSGQQYLLGYSYYSRRLGLSLQHIERSAGYGDLGTLDGEYQLSRRTDQATASLTFDEQGTIGTGYFDIRARDGSRTRLANLSYSRPIGSRSSFYLALNKDLDGDGYSALMQLVIPFDINGLLNIGVTRDSDRRYSERVIWSRSTPSQGGLGWNLGYGGGASRYQQADLTWRMQNVQLQGGLYGETGNYTRWADLSGSLVWMDNAVFASNRINDAFVLVSTKGYPQVPIRYENQLMGSTDDNGHLLVPWVAAYYPAKFQIEPLDLPANVSAPEVEQRVAVRQGSGLLLDFPIRAVVAASISLVDERGEPLPLGSQAEETGSGQRASVGWDGQVYFEGLQSDNQLRVVRPDGRACQARFRLDTRKPTVSQVGPLTCSAPIGDTP

SEQ ID NO: 30711 - protein, 415 aa, Pseudomonas aeruginosa
SSPTESGRLPGRLPILAALAFPSQAPVLQVLQAGAIGLEADPQQDHRTKHRGQGHQQQRVAQRHVVGEDEIGDQRHRRRAQAETEQGDHEQVDRRGLAAHRVGHDLLDRRRGHAERHAQEEHRRRHQRRRPIGVVQQRIDQGEGNHRPGGEQPDAHVRVAAPALRPVVGQAPAEDDAETAEHRDDAAVDHPDMTGVPAVGADEEGRHPGAAAVAGEGQAGETEVVAEHGLAVGPQVGADLAQRHRHACADSAPGRLADSQQQQAEEHAGGAEDEEDQLPRAHLAEQRQMHVALGRGELDHQPAEQEGQPRAQVDAHRVDADRRRPTLAREAVGDQRIGRWRQRRLADPDADPEGEELPLAAPPDRRPRSSRSTPARRTGSGRAGCGCRPCVRAGYRKGCRTGRRTSPSAGSFPYR

SEQ ID NO: 30712 - protein, 171 aa, Pseudomonas aeruginosa
ATAGHSRSCLILSSGVQDIGQRHVQVGELKTVAGVLQALRQGSLAAEQQSGHFSQPEAQDEPGGRYPRRLVQRPAQGLGEIAVAHRVGSARIIGTAGIGPPQKKIDQLDLILDMNPRHPLPAVTQRSAQAEPVERQQAPEEAALGGQHQAGAQQHDTGAELLRLAGDLLPG

SEQ ID NO: 30713 - protein, 837 aa, Pseudomonas aeruginosa
IARADRAIPAWQRAASGTADPAKAPLPSPPACIHRPAGLPATAPDRTRPAQRALGFPDELAPPRTRRPADPRSHSSDRRPSGHPARLGAPLWPGGAATHRQGAPALQRRAGRAHPPDTRLARAWRRHQPGARAAGASGGNPGGGCRIPLGTPARTAAGRHRRAGRATPRRSVQPGRVALSGSDPLRKASATLAAAPRTTLAGTVRRAHGAGLLLLLVAQQAGRPPLSPATAATGRAAAAGQPVRAVAGTEPLAVQLVARQRRGAAAGLRLAAATGRTGPGLRTPGSSRRVAVRQSSPQSGAPAAPAGRGELPGGAGRTGRGDPARSLRNPGANWPAAGEHAPGSPPPARRTRSVEPMNGLPMNLIWFRCDLRTTDNSALLAAADGRPCVALYLLSPAQWREHDDAPCKVDFWLRNLGELQRQLAALNIPLLVRDCGHWRQAPEVIGRLCRELGVGAVHVNQEYGVNEERRDQAVGQRLREQGVAFHSHLDQLFFAPGSVLTRTGGYFQVFSQFRKVCHERLYQALPGVRPRPQPQPPHALASDPLPDAVPAFPRPADSLRRLWPAGEEVAQERLRDFADQHLADYHERRDFPALPGTSQLSPYLAAGVLSPRQCLDAALVANRGEFSGGQQGAATWINELLWREFYKHILVGYPRVSRHRPFREETEALRWRQAPAELEAWQQGRTGIPIIDAAMRQLLATGWMHNRLRMVVAMFLSKNLLIDWREGERWFMRHLIDGDLAANNGGWQWSASTGTDAVPYFRLFNPLSQSERFDPRGEFIRHWLPELAGLERKAIHDPSSLGLFAGVDYPRPMVDLKASRERALAAFRNLPPRDGRA

SEQ ID NO: 30714 - protein, 382 aa, Pseudomonas aeruginosa
PAVAGWSGRPYRNPPGAARRPRPRPGTAPPANPGRQDRRSVRGCASGAAGPRRRPAPAGSGDCSAAVPRRSACPLSESDPLVAAEVAQRMYPGEAAGAEQFAHRRPLIIAVLEQQPAFVQQMLRRLGDDLADIVEAIATRDQRALRLETHVALAQVRIAGRDIRRIADDHPEASAIESGEPVAAAHLDVLQEQPLAIALGQRHGLFHAVHRSHRPQRPFAGQGQGDGAGAGAQVEHRSGIRREGRQRGFHQQFGVRARDQGVWRDLQVQAPEALVAKYVGHRLAVAPTGDPVVEPLVGLARHDALRPGTQEAARLAHRRRQQQLGVEPGAGRIGQLGILEKGTDSGHVSRPGPPVDRPGIPAAAARSPVPPRPPSPRPGSTG

SEQ ID NO: 30715 - protein, 445 aa, Pseudomonas aeruginosa
GHPAFSAEKLSCRHRYRSVARRALVEGEQLLGQGQRVDAALGGHFLHLHAGRVQQFVGQAAGQLGHHLGGVGTVGQLPLGLAQLLIAQALGLLPIGAQHVHRGQFAQALHELGDAAADQFLGGLGSALAALEILRHYFVEVVDAIEVDVVQFADFRLDVARHGDVDHEHRLVLALLQRALHGALAEDRQLAGSGADDDIAVGQLLGYLRKQHRMGAELLGEQAGALQGAVGHHDALHALLEQVARDQGDGLAGADQQRLAAVQVAEDLLGQAHRGERHGHRVLADGGIGADGLRRTEGGLEQAAEQRTDGAGLARDGVGRLHLAEDLRLAEDHRVEAGGHAHHVAHRVFVLVHIGTGAQLVESQAMVVRQPGEHVVRGRMVDLQVEFAPVAGRQDGRLAAGGQAAELLQRLDHLFRSESHALADSHRGGLVIDAEGNEGHAGSLS

SEQ ID NO: 30716 - protein, 107 aa, Pseudomonas aeruginosa
ATMWCRRRKPATPGFPSAPSASPNTSAPTRKPSTPPCSGRAARRTTSMPNAPPRSSWPAPGATRSPWCTWRRSSTARATRTSTSSPCLPRRPTRIPAPACCRASTTC

SEQ ID NO: 30717 - protein, 368 aa, Pseudomonas aeruginosa
PCSRTTPQAATKWPPCCSARACCITMKRSDDALPLLKAGIKEHPDDKRVRLAYARLLVEQNRLDDAKAEFAGLVQQFPDDDDLRFSLALVCLEAQAWDEARIYLEELVERDSHVDAAHFNLGRLAEEQKDTARALDEYAQVGPGNDFLPAQLRQTDVLLKAGRVDEAAQRLDKARSEQPDYGIQLYLIEAEALSNNDQQEKAWQAIQEGLKQYPEDLNLLYTRSMLAEKRNDLAQMEKDLRFVIAREPDNAMALNALGYTLADRTTRYTEARELILKAHKLNPDDPAILDSMGWINYRQGKLADAERYLRQALQRYPDHEVAAHLGEVLWAQGRQGDARAIWREYLDKQPDSDVLRRTIKRLTGAETP

SEQ ID NO: 30718 - protein, 418 aa, Pseudomonas aeruginosa
PALEVVCLGASQTKLKLIKSRPFFQTTFRGSSPKEATSRCCTGSWKLWSEKGMPKRHSSNTTGASPSGKAAGFDPAMRWFESSRPCHFPLLYFIRIPSVDTGTCSVSKMMVFTGNANPDLARRVVRQLHIPLGDVSVGKFSDGEISVEINENVRGKDVFLIQPTCAPTNDNLMELVVMADAFRRSSATRITAVIPYFGYARQDRRPRSARVAISAKVVADMLTVVGVNRVLTVDLHADQIQGFFDIPVDNIYGSPVLVDDIEDQRFENLMIVSPDIGGVVRARAVAKSLGVDLAIIDKRRPKANQSEVMHIIGDVEGRTCVLVDDMVDTAGTLGHAAKALKEHGAAKVIAYCTHPVLSGRAIENIEKSVLDELVVTNTIPLSAAAQACGRIRQLDIAPVVAEAMRRISNEESISAMFR

SEQ ID NO: 30719 - protein, 187 aa, Pseudomonas aeruginosa
PQVFRPGRQVQPPGQGRSSVDPDHLHEPQRPVRSGAGGILPDRPGRHPGGPRRTRHAPWRRQAQDRRRTRRAQRVARHHRPARQSEFFPSPAAWHRPSGAQQPGFRLRARPRTAQRAGTARHQHRLRPRRAAGNARRGLDPGDAEAAQPEGLNHFSSACLSARDIAWDSTAASSACPTSASPPCSTP

SEQ ID NO: 30720 - protein, 119 aa, Pseudomonas aeruginosa
RTRRMARHSSPLRAGSSMRASRPGTAQVAPRPSTCSSRNRLPSSPSPAKRIAGRPTNHRQRLRSLSSMRAATKLWTNSRAACGPWSRLPRASSGQRTGSPISRGLSGRPAARSRSRSSR

SEQ ID NO: 30721 - protein, 738 aa, Pseudomonas aeruginosa
PGSRLAKGSPVGSSTSRVQEPACSSCKAKRGGGAWTAGDSAGASSTGATGSAFFAAGAPGFGRLIGIPRPSTGAAGATLGALAGASACGTRACGASIAARARTGTAGSSRGGVSSNSGREGAANGNGWRGSQLVICIAPRKARRRCSSIKSRAPAIRRCAGTVSPPAFRQAMIAVLRPRRSGFVPPCDGSPSTRGDGEDIDVALQLEGAVDACADQVGLHQPGIGTARLVGASDGEAQVLEAGVLQADAQHRAVEGGAVAAEAVLDGHHVQGDFVEAELAADIVDHQVVVAAAGRLDRQARAAAAGAARLRRIFLEIERGADADPGLADHVVQIAIAQRAQLGPGRSAEQQRQRREDADAACQWMSLLGHVLRTSFPAATSEVVRRHLQVVEAEPGYLVAAHVVAAGRYLPVAWPGTADVEVLDHQAGARRIGVEVSGVGQGQLGQFESEVAVGGDREQQRLRLPVAKRDAGIGVGQVDGARGLLGGADATGRASTAGHDLESLGVEVQAHLANQLAARVGAPEAQVGTVHRQFGEVQVEHIGARGSDAEVEADAGVDLFAGPARAVAAGTGVTSDARLAAGAAHQAGESQLDHVRGVRQGADHPPVVELGGQHRTLGQIQLEREIETAESHRRQGAALVAASGGDVQLLYRDRHVLPGGGVGHAIDRDGGLVAVDHGAVEDEADAGTLHVRQLLVVERCHLGMGEGGGQQGREQAGATHLSSPCSGRPGRCPAVECH

SEQ ID NO: 30722 - protein, 493 aa, Pseudomonas aeruginosa
TAAFRHLDDSQMPSADTGPVPAPQTCRRPASHSSAASASPVPLQYNRRFFHGPALPMIDPRRVLRALAEHWALLEPLCERFDAGTLSLAELRSQLNTQLPESNPAEITALLDQWIRLDILVPVAKSPNRFELNAQIHDFLAYLRHEHRLGLCLEIEAYLRHLERLAGYIQDAFETRDSQDLARQLRLLDMRVRDVLKKLGNDEQALIGVAERAKTSDRQIPLAQRYAEVLATWDEYVEPMIQLVSADGAFEQGVRRVEQVLLRLLGEQQRLGHLVDDDLVLRTHARILEMQTNAQLTLRRARELLLPLREEARRHNAVTRGAALALAAIRRKGLDAVPQAAMPLFTRPQSTFLGTASQVESYVFALARFEPKPAQFPKSSGTRKSQRAGATTTDRAGNDRALPGGAAAAGPHAMAAGPGTGRRHRRVALLVLPAVARRALPARTPATPRVRNHRTLRQPLLLRPDPRRQGQGPGQGRRHPFRERNPCILISPN

SEQ ID NO: 30723 - protein, 224 aa, Pseudomonas aeruginosa
RRRLGEERRSHPRPLQRRAFRGSRTEHRPVAHRTAGVAGPGRPRRPARPEGTPGEGAEAAQDPAERRCRPRREQGPGGEAVPGRAGCAEGPGRLPPHPDADRRGAREARRTGPAGGVPGRTQALQRRLRRARPATLRAPATGGPATGRPGGQGAHPGRCPAPPPATAGRPALRHAVHGAGGRLAGQPAAAAQRLPGHLAGAAAHRRADRGAVRPGAPEGRRQVR

SEQ ID NO: 30724 - protein, 244 aa, Pseudomonas aeruginosa
RRRHRAPPEAVDQRLRASPGRGPDAGQGAPRGGHRHRPDPAQHPQRLRQPGTPVGPVQPRDQQAPGFQPAELPHRPRAEQGCAQAHRPDHPQRRPVRGRREPLGVRPDPERRAGREERGGQGIPGPPGRRQPQPVGPEGPVRTGLRDHQGQRPADHAHRHRRRRLQRHHHDHQGADQHVPVAAPDGPRAGRARAPALLPGRGGGHRRAQPGRAAGDQPATGLRADPGEREAAGFRTRGDRPGRR

SEQ ID NO: 30725 - protein, 534 aa, Pseudomonas aeruginosa
GQRGPQPRTRRWPELIGAASTPVRLRTGSRRRTPFWLFLPVLLLALLASLPLLYVAAKAWDAGWHIAWQLLWRPYVFRLLGNTLWLMFGVTLLSALLGLALAWCVERSDLPARRFWNVVLCLPFAIPAFVSSFTWVSLSPMYEGLGGAILVMTMSKYPLVYLPVAATLRGIDPSLEESARMLGLSRRQVFLRVTLPLLRPTLAATGLLVALHMLVEFGALSILRYQTFTTAIYQEFELEFSNATAAMLSSVLLALCFLLLWLELRMRGRGRLVRTGQGSARRAERVRLGFGKWPLQALLATLVLVGTGIPLVMLGYWLYEGSSASFPLMEIASTLLSSLSLAFGGALLSCLLALPVSILVVRYPGALARWTQRLPYLLQALPGLVIALSLVYFSLHYLPATYQTTGLLLVAYALLFMPLTQAPIRVALEKASPQLEEAARTLGQTPLMAFLRITLPIISPAIGAGFVLVFLDTMKELTATLVLGPTGLSTLATSVWVHTANLEYAAAAPYAALLILISGLPVYLLTTRAHLSTH

SEQ ID NO: 30726 - protein, 345 aa, Pseudomonas aeruginosa
TPETRVSRPVTPARETRGLTSQKRVSLLRYSWASFLISMVATTPLMSLLTCRSVTLPTEMPLYSTSVLLAWIPSPLSKRTWMSTPAWSKARHASQAPMARATSGSTQIADQFEVLCFFGLGRSLILVIQIGVVPDQPGVERHGGEHGEHHHAGEGGGAEVGLDARQVAEIHQRHEDGDDEDIEHRPAPDPFDEAIHQDTLAGRHRLVPLYRIEQQGDAHQLESRNQDTGDEHHHGDGEHVGMHQFDHALHDGGRHSAAEEVDRHYRQQVGGYVENRRGDQQRPGAREAVWAPGVQHRTAAAATRMLVPVGAIQLVALAAHQDSGIKRAHRRPRRPALPIPGAATW

SEQ ID NO: 30727 - protein, 220 aa, Pseudomonas aeruginosa
FGIDDESLPIQRVDRRALALGGGADPAVGHRRGGTFVGRRHGAGAEGQGDQQRRYAECRFAHLVHSPAEAACSMGAGLLRSSDSSQTKQIGTNSTPRKVALSIPPITPVPMARWLAAPAPLARARGITPRMNAMEVMMIGRKRRRAASMAASRRLCPCSQSSLANSTMRIAFFAERPMMVIRPTLKYTSLDIPLTITASTAPMAPIGTISITDSGIDQLS

SEQ ID NO: 30728 - protein, 195 aa, Pseudomonas aeruginosa
VAVMVICGGATLGYCATGNLEMTSRPAREMNRATTQAKFGRLMKNSDIGKSSGRTRPYCCGAGDWACAWAPSGFGTIFTPGCTAARPPTMTRSPGSRPSVICQREPCMTPVPTLRDSARSSAPTTITWALPSLERCTARCGTRIAWLSMPWGVRTRTYMPGSRTPSGLANLPRRAIWPVPRSTATSANCNAPWRS

SEQ ID NO: 30729 - protein, 132 aa, Pseudomonas aeruginosa
RRTRACASNSTARFRASSPSARDTAAFSGAGSIWNSRSPALTSAPSSKRFRTTMPATRARTSATRTGSIRPGSSELSARGSACTVRTSTGNTISAASCRSSAGPQPANAMAIANAPILPIARKSAMTHPTVD

SEQ ID NO: 30730 - protein, 212 aa, Pseudomonas aeruginosa
QLIPLDARPVFCTMRTIRKTNRDPSMTLISHDERLIKALAVAIVDRPRATLKELAEAAGVSKATLHRFCGTRDNLVQMLEDHGETVLNQIIQTCDLEHAEPLEALQRLIKEHLTHRELLVFLVFQYRPDFLDPHGEGARWQSYLEALDAFFLRGQQKGVFRIDITAAVFTELFITLVYGMVDAERRGRAASSNSAHTLEQMFLHGASNPARS

SEQ ID NO: 30731 - protein, 1428 aa, Pseudomonas aeruginosa
LSTESHLPQEFRSVSTPSLTPSPPPAGDPLTVPDRPAAKAGLLLLVLLMLGLLLWQMSQELRQQERFEHERAAAQLDRLNDRLSLTLELKARTALALLPGVPPSERGEIQGRLLPRISDALPQVRQLQWVDSALQTDSPSPETTLPEQLRQHAGSGLYHYCLDPRDGESLYLTLREPGSRRDSGFWLLHLASDSLAQWSPDLPTGNLLWRLEDQYAGRVLWHTPGSTALLDDMQTLGVEPLRNSDWQLRGLYDSTRVRLGLLPGIGGELAIFLLLVGVTVYMLLRLHREQQGLRAMTLASQRSLRQAATALAAIDERVLVTRADGRLSYLNPQAERLFGISSAQARQHHLLGLLPDLEPGWLTDAGGDGETRSELLPLRVRGEPRTFTLSRHPLASYPALADQAWTLREQILQGGQVWVLRDVTEEQHALGVLEETRRRYQDIFEGVGVALCVLDLSALRQALVEQGLDSCAALRAWLAGEPGRQQALLERIRITEINDVSRRLLQIESTEQAWQRLLDHGPLQPDSLRLQVIEALIERRPVLELEATLRCGKSTPRHLWLQLRLPENPGEWHAVPLSLSDVTSRKEVELSLIEREKFWSDAVQAVPDTLYIHDLHARRVIFSNHHLGQQLGYNQEELARMGENFWETLLHPDDQEYYWRIRNLQHVVGDGLLLDSQLRWRHRDGRWHWFDIREQAFSRDRSGRVARLIGVAKDITFTVEANNALRENGRRYRMLAENISDVIFSTDAELNASYVSPSVQHVFGYSPEWALLNGLHQTATNPRQLGRLNGLLRRVRHAIGDRQKLAELRENPGQHLFALDCLRADGRKIPIELRIVLMWDEHDRFEGLLGIARDISQQRRAERELRMAATVFEHSTAAIMVTDPAGYIVQVNDSFSRLTGYSPADVLDQQPRLLTADRQEANQLKHVLASLQHSGSWEGEILQKRKTGELYPSWVGITAVRDEEGDLVSFVCFFSDISERKASERRIHRLAYYDALTHLPNRTLFQDRLHTALQQAERNGQWVVLMFLDLDRFKPINDSLGHAAGDRMLQEVATRLSACVSQDDTVARMGGDEFTLLLPSQGDREIALKRAIQVAELILGRLARPFTLEGREFFVTASIGVALSPQDGAELSLLMKNADTAMYHAKEMGKNNFQFYQAEMNARALERLELESDLRRALELGEFVLHYQPQFTGDGRRLTGAEALLRWQHPRRGLVPPSEFIPVLEEIGLVAQVGDWLLAEACKQLRSWHKAKVRVPKVSVNLSARQFADGQLGERIAAILYETGIPPACLELELTESILMSDVAEAMQILSGLKRLGLAIAVDDFGTGYSSLNYLKQFPIDVLKIDRSFVDGLPHGEQDAQIARAIIAMAHSLNLMVIAEGVESQAQLDFLREHGCDEVQGYLFGRPMPAEQFGMLYASDVLFMFNEG

SEQ ID NO: 30732 - protein, 210 aa, Pseudomonas aeruginosa
RWQSSSSAKKVCATGAGSARPVHSITRRSKSISPLSRRSSRRNRAFSRSVLIEQQTQPLDSVITCTGSTPSNWPSIGVSLYSFSITAIFMPCSACSRYLSRVVLPAPRKPVSTVTGIGAWLSLATSDMRNFQKRRGPRQTWPAEGWGFSSSGSADPCRHRSAPPGARGRTPRRSSPACPGACCACARHRCRSRACRPASGRPGPGICPCG

SEQ ID NO: 30733 - protein, 271 aa, Pseudomonas aeruginosa
PRRALVLQPLVPEVMPKVALPEVPLVVVASRCGNRPRWPSNTMLPQPQPLPPAASACAVMLPRLSSPRTNPLLKSRLSMSALRSCILEKNALAALARLDELSNSDTCRRSSRTGGDGRHRRSNSATSPPAWLGYSGIQQRAPRDRDMSDQHDERRRFHRIAFDADSEILQGERRWEVLLHDVSLHGILVGQPQDWNGDPQRPFEARLYLGLDVLIRMEISLAWARDGLLGFECQHIDLDSISHLRRLVELNLGDEELLERELALLVSAHDD

SEQ ID NO: 30734 - protein, 215 aa, Pseudomonas aeruginosa
GGSLEEGVQGLLEARHGDHLQSRRRLLRRVAEGYDGTLETMLAGFLQALLAARHRTHLAGQPDLAEHQQVVRQRAVAQAGHHRRHQRQVGGGFQHLDPTHHVEEHVLVVGRDTAVPVQHRQQHRQAVLVEAQGHPPRIRQVTGVDQRLDLHQHRPRAFPGGHHHAAGHRFLGPREEDRRRVAHFLQAFVGHAEHSQFVDRAEAVLHRPQQAQAAV

SEQ ID NO: 30735 - protein, 425 aa, Pseudomonas aeruginosa
FALEIQYGVDHVFEHPRAGQGAFLGHVADQKDRRAALLGIAHQHRGALADLGDATRRRLQLLGEDGLDRVDHHHPRLLLARGGDDGFDAGLGHHLELVFRQRQAPRAHRHLLLGFLAGDVQRRDAAGQVAKGLQENGRLADAGIAADQHHRTVHQAAAENPVQFGGAGREARHFLDADLRQGLQVGLLAGPAAAAGAARRGLDDGLHQGVPGPAVRALASPFREGRATLGAAVHALGLGHGNSSRGQSADDSRWLDSDQPRSTALRATLMAGQGDFHAHTAVPAPAGCRDLGRRPPGPGPRHPPRRPAPPRSPGDPRLRAGLRADRHPRPAAAGGQRPVAGQPVAAVRPLVRRHVGGPCPAAQAAAPGGDRRPGRACAPAPDPEPGRREPAEAGLAHRRDHPGGPGFRRGRTEFPFRRRLLSMPT

SEQ ID NO: 30736 - protein, 684 aa, Pseudomonas aeruginosa
RWRPSGRCCRAHPGRRGRHRPPAIVPPLRHGRGRRPGSARYSPWHPAHRGRSRPRRTPSAWPGHRVGRHRRSSRATALRPRPHAPRQLARPAPRAASLPESNLASSSSPTKPIEEGRPGWPPRLRSILELRRQLPDALQIGPGHLGQARAVVAVSLVEVGKHDVLALVVGDRQRPAETGDQVGLVLLAVGAEQLAGLLEVLLALDLRLLGGAAQRGPHVAGAGLLLARIEPARLVVHPAGTVSGVQRAVLVDGIDLAARAVDRQAQAVGADPVHLGIGVGEQPSLEQAILGGLDARHQVRRRHGDLFGFLEEVVDVAVQHHLADLALGNARPDLGRVQRVEVEFRQVLGLEHLDVQVPFREVALPDRAHQVIGHVAVVAPLDFRHLFRIEVLLALQALPVELHVVHFAPGVDQLVGMHAVAVHFPVAGRGALVGIQQGQGAGRLRHVGEEIEASRVVVEVAARVRLEGMDHVRELDRIADEEGREVVAHQVPIAVCGIELGGETARIAQGFRGVVAVHHRGEAHEYRGLLALAEDLGHAQVADIGTGDELAMGAGAAGMHHAFGNTLAVETLQLLQQLHVLQQHRTVGPGGLRVLVVAHWRTVVTGQGRGLHGQRQEAGGQACRHQQAAGTEGVQGRVHGRAPNGLSGVLLRPTKVRSAAGDAKLKNLTAPIRNINAPMNRKKK

SEQ ID NO: 30737 - protein, 296 aa, Pseudomonas aeruginosa
KRARTGPFSLPDNTPGGSVIRRYCAGTHLPVVLHRHLPRAPRQTEVHAASLQHGAGVLDHLRVAAEHHPRMLRGQFQVGGTLQIAVLDQRGDTSVQATGYLLAGHHRNELQLVGMLGQVFALGEAGDQLAVGQLLALTHAVDQLDAFEALPDLEVLQDRDERRHTGTGGQQPKVTTIHEAVEGEEAEGLAIDQQLVALAQAAEFAGELAVRDDDGKEVEEFVMRRRNHRVGAPDDTAAGLVHAEPGELPGAEPESRVTAGTQGEQVGSQRLHVEQRLAGEFLFAGGHGPLRIPILP

SEQ ID NO: 30738 - protein, 310 aa, Pseudomonas aeruginosa
LVGKETTNQSRVKNFSAYPCAAQAGELQPALSFDRLLIDERDSPRREPDASIRHPLRPARPGPPARAGRRAPPGVRRRRRIPAQPVARTGRDGAMPGAGPQRRLRRPRREPGAARPGHQQRRFAPGLPRPAQEPRAQRPRPGLGALRPGQRNRRGALRSRTGQGAEDPRVAGGATDPPARPTGTGRAGRRRGDGQALAARRRRPAGTLHRPDARFAGGEAGPPADRRGSGAPATALALSDPLSPGAAAADAAQPRQRILPGGSRHRHPRLPPAPATQPRRATRRRPGLRQRGARHRLRAAQPAGRADPGG

SEQ ID NO: 30739 - protein, 622 aa, Pseudomonas aeruginosa
VVHGRAVGAGKLASGAGRAAGDVPRRRWPGRPGGGLAGPGPVQPAVPPAAGGRRLPRLAHVSPGSRCPGGGRRTVDRRQPPPGLPRQAQAAVPRGRAGRGESEVRDPESGKIVSRAPPGCPRRGVRPDRRTAPRTRPDDGPAAHGARPGRRPVAQARPRKRGRTAPDGRADRRTGETRWLREWPSRPDARGYRRRSRACRRAGRRWPGPCCSSPPRRRRPGCGPCPTMHRGCGQAAAAPAGPGSPGCLRHAPPPAPRRTPRAPAPRWPPAGSCHQPGAPGACRCRSGAPARPPGPGTAPRRRRPSEPLAGNAVADAKNVRQHRQGDFRRRLAAEVEADRRVDPRQFGIAQAADAPQALEAFLRGRPRSHHADIEGFGTHRLEHRQVVDLRIVGQRHHRRIGVATAVGDEQRGQLATDLDALQQHAAQGFFARVAEDHLEAQALAELGAGMGDAGIAGQQQALGSADAQAHALAVAFSPRAVAGIVAQAARAAAQFDLAQQAALTKQRRLQLAQMGLDIAVRRQVFHQYVEDAAAGQADVRVRVVALAVAHDHRGIGETAGGDPLEEIILDAAAGQRADPFTAGVHRQQRSRRAGRRAIGREHGTEPHPFAAHGPLQRLADHL

SEQ ID NO: 30740 - protein, 440 aa, Pseudomonas aeruginosa
IEVLHDSLHLDGMRRSALHLQLRDLLGTEVTGQSAPGLAQVVEQVRELLVVEFPGETGHRLHAFEAGELLFDDAVFDHSQQITRVLQAQGSVAVHRHRDMRLALAFAAVAAGADVEVLLATALAAVVQLRLGQRLDHLGRRRLVAEQVGGHGCQVAVVEVLGAVVHHREHLVEHAALGAHAVLEEARQVRLGPTARGKVAGQQAGRQVAVEQAAAQALVLLQGAGQVARGMALAAVAEHLDHVLPALPGLAAPFLRLQAHALAVEQVPAGQAHAHVEREAQAGLRRRPGDRLLGHQVGVDGVGILALDQVIGGVGHRRIEVGAVLALALGKSGEELVGAVGADAVFLVRGDVGAVDGAERRLDRQPAGERRAALGGMAGHAVGGAGEVFAALDQRRVGAGGGGQERRQRGQRQGEAGKGPLHPQASLTRPSSSSTSRVAL

SEQ ID NO: 30741 - protein, 701 aa, Pseudomonas aeruginosa
RGVLLGLAHQVGIALGGEPQLGPFGLGGLHLVRRTAEEVADHEGLRGGHPGTDLGADVAQADAPVGAELDARHRRLGAGAEVLLANGEADPIPVVRVFRVEALLACVAVLPDLVGSGLVEDLVQAQGTGRDRALGVLHARAQGVATTQVDGVDAQPASDLVDHHLGRGHGLQGTVAAHRAGLHAARMIGGDRQVVLRHVVDRLRGGGAHRRHRGAVVGAPAAVGAHVGAEDAEAEVVPVYRQLVADVERVALDAALELLVAVVGQAHRHTLAIQRGERGIEDEDVVVLGAVADGIARMDVELLQGEARRLDHVHAFVGDFERALGGDHEVQGLARRVVPAVAVVRLQCRRLDRWGLVALVEDQPVLRRVFQLLGHALGMEQPLLGEVAVQLRLAGPYRFAVEDGGEQHRVLQAGELVVLVGRLAADPDEAIAAVGIALVQRGLGAIADRLVVELELELGPAEALEVVPDQDRHRMADEHRHLARRQERIGRMRLGEDDAVLLQVGGGDDTVRLQLGAQPGKVVAFVDAVGANGLQQHGVALLLRPAGHVPGADIAGEHLVAADLGQGVVTETDLTVARHPALGGNGHLVLEQGSERLAAERRQGDTHAGDQPALEKGAPGYITVGHASSSGWYGSHPCRYSGLNSSSGRTRWSTQAEKPDSGVNFSDKSHPRKSPVYRWKDPWTLDFGRLPGRLQPFRALL

SEQ ID NO: 30742 - protein, 421 aa, Pseudomonas aeruginosa
IFDFGNGNSQEVTTCYSPPSSRNARPQHVQPTQLPAPPSSLPRLLAGPRLHRQRLPDAHRGHRLAHLRTDRQCPRPGPGRPGRIPPAGTVHAPHRACCRPLRPTQNRRPLPGRPGPGGGGTGARRGFGRDHPQHDLRPRLRPRYRPRLRNADHPGAAAEPGTGRAVPARGGRFGFGDAGGDHCRPGPRRPALCVRCLLGLRADRDSLRPRVRPDAQPAGTQPAAHPGQGHPRLAARRHPFHPQPTGHLRGNLPRPVRRAPRRRHRPAPGVRQGHPAHRALGPRPAALGSSGGRPGDVVLAGALQHRTQRRADHVPLRGHLRPGNHRLRPVEIVLAVPRRAGGTRRRGHGQHGHPRRLRAARNPRRDARPGQRGERPVHRRLEPARRVRVRAHRTLVRHGTGSGPRRDRHPGGHRSMDEAVP

SEQ ID NO: 30743 - protein, 614 aa, Pseudomonas aeruginosa
ARTSLSAEPERGSVSSLRNGGRQGSEARHHVEQDPRLALPIALVGWLADDLAGNLRVERQLVGEVEAHPGTDRAELLLLVIVHVEVVGLAPVVESVGLVAAQPAIAHRLAIARFELQGEATVTGDVARGEAATDPAAADAEALARQQRVEAVLPLQLAIHRPGSAEPLQTPDVAVEIDETSVGHFAGTTFIVLLGRAPHVQADVVAHLRQVDAHPAVDPVIGQALLEHPHMVTTGVRGVAGEVAQAGLGILPLQRQAAAQVLRARADEGMVVGNAAFGALADAVEGEYRVRNVRVDLRIGTHDLQGIAGEHATQRQRTAQLDVAGGIAERRDRAEYVDLLVEAQAGELGGAEGQGGRVGVVRAAVVEADEAFVSLLLQGHVEVRRAQRLTRAEHALHVDPRQVADQQQAALQGIGIQRTFFGQRREQFLHSHPRPIDGSLDLHVFEVTLDHLQAYLAALDALLRHHYLGQQVAVLAVLGGEAVGQVDQFGQGHLLAEHMLVIGLEHRLVIAGVAFDAYLAQFEADLFAALRRDLLGHHQRRLGLGLRLAAGLEAFIKLGWLYSPWQLHGGGGSSQHPAATERHPGKRPLRMFHHSPRADDALPPGDDSAHCEKG

SEQ ID NO: 30744 - protein, 203 aa, Pseudomonas aeruginosa
ALSAMLRLTLPEVSTRPPLPPWAPPRARIRPSMRVLPSDQTTARPPLPLPVAETSMLAPLASVAFFARGSSPRPWKSPPMRTLPPCAAPRASMLAVLARATCCPLTSTSPPLFGPLTSILPATWMSPDLLTSATLPSRTSVPRARITPDRLTALSTTREACSAVISTLPPSAWIAPPLLTSAWASCGLRVTGSVTAMDTRPSP

SEQ ID NO: 30745 - protein, 375 aa, Pseudomonas aeruginosa
LKNDTTEVKYVIPSKNRLYFLDNHCQENRKTSLARGFARLGSPPSAAAKEPSMSHALRAVFLDHASLDLGDLDMRPLRAAFDELQLHAASQPQEVAARLHDARVAISNKVPIDAQCIAACPELELILVSATGTNNIDLAAARERGIVVANCHGYGTPSVAQHTLALLLALATRLPDYQQAVRSGRWQQSSQFCLLDFPIVELEGKTLGLLGHGELGGAVARLAEAFGMRVLLGQLPGRPARADRLPLGELLPRVDALTLHCPLTEDTRGMLGAAELALMKPGAFLVNTARGGLVDEQALADALRGGHLGGAATDVLSVEPPRNGNPLLAPDIPRLIVTPHNAWGSREARQRIVGQLAENAEAWKAGRALRVVNAG

SEQ ID NO: 30746 - protein, 239 aa, Pseudomonas aeruginosa
RAALPALAGAYRTGAGRARPTRPGPALQPAADRWRAAGGEPAGGVQPWPPGSRQRAAAGATASPARRPSAGLRLRCRGTRGGPQASLPRQSPEPARRRRLRCREQPTDPRRQRPGRRSDRRRRHRRRAARTRRDRQQPALPPGRAHRLPGLRAPAATRRRAPGAGRRTAPGRQQLPEVPAVDRTPPRPLPDTRRRRRFPHLLRPSLLISAWNPVNEAFPLPARTPAARPFRGHPPGGRR

SEQ ID NO: 30747 - protein, 216 aa, Pseudomonas aeruginosa
RTMPATSAYRPSPCSSSAPASPRRPGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 30748 - protein, 388 aa, Pseudomonas aeruginosa
LVDPPLRKPDGIAVRPYPHRCPRGNRRQDPVAGTPARGAFPQAVADHRRHRRRHPGQPFRCRRGGRLGRQLLLGSHPQLDPRRLLHRRRPVDAGTGQARRRRVRTEEIRPLPHHPDRVLPRRDGRQDPGRHGHAGRPVSAFLAGGDRHHPGHADRPRTGGTDRQPGRRQAAADPDPPPGRGRLRRTWPVRRLARRAIDRLALKDCAAGPGMAGRPMQNAWERLQFRQAPDACPTTRPREPEMPSHDLKRLARHHIELSWNKGRMALVEQLHSKDFLYKSSFIGRPLDTAGYIRLLQDIRTAMPDLEVVVEDCIGEERKVFTWSTLIGTIVRPTLGYPASDKVLSISAMGFWVFNPQGQLQELCTMFDMESFRAQLGLQTRPFAEKTLP

SEQ ID NO: 30749 - protein, 113 aa, Pseudomonas aeruginosa
TPAATKSPRCCAAPCRTTPSCSTPSWPGNPMPSIPMPPSPGNPARATARTAATCPGGIAAPTASRSWRPWPTASIAKSCCPPGCARTSSMPVRKRTSVPASSTRPLTKWAARP

SEQ ID NO: 30750 - protein, 185 aa, Pseudomonas aeruginosa
PRACPAWAGDASRIAAYVVSGIGFLGGGVIMRDGLNVRGMNTAATLWCTAAIGVLCSMGLLLEATLGSLVVLCANILLRDIAQRLNRQDVLPASEAEQRYEVQIVCRAEDEIQVRSLMLHSLGSSDLRLQSLHSEDLDNPAKLEVRAELLGTPEAPAQLERLVSRVSLEKGVSSVRWQVFELAAD

SEQ ID NO: 30751 - protein, 151 aa, Pseudomonas aeruginosa
AWLSSIAAPPMSSVYNRAVQFSATPLGGLRSIHMEPESMMGEFEAIRPYSDAEVPAVLQRLLSDDAFLGALVRYRFPRLAGPLGWLLKPLIAHRLAREVTGIRSVATLQDKFEPYVDHTIEKATDGVTYSGVNRLKPGLRPTCSSPTTAIS

SEQ ID NO: 30752 - protein, 168 aa, Pseudomonas aeruginosa
AARTNPSPKWCAPCISSRCRSATNTTPATWPRPASCTPAPAPASTARHRARTMPASRGHHRYKGRCTSTSARGGGSSAAKQLAAELDRQILGNYRLFPVHYLAYEMSENRDPGLAVPTAESLFGSEELEKARKEWNRRLEQCPAEQRPWLVLQYANPVLNQYRIKQQS

SEQ ID NO: 30753 - protein, 225 aa, Pseudomonas aeruginosa
RNFFARPRWRQSPMPVHEIRHPLIRHKLGLMRRADISTKNFRELAQEVGALLTYEATKDLPLEQYEIPGWAGPVTVEKISGKKITVVPILRAGIGMLDGVLSLIPGAKVSAVGVARNEETLEARTYLEKLAPDIAERRSLIIDPMLATGGSMVATIDLLKKAGSKEIRAMVLVAAPEGIEAVRKAHPDVIIYTASIDEKLDENGYIIPGLGDAGDKIFGTKQKEA

SEQ ID NO: 30754 - protein, 311 aa, Pseudomonas aeruginosa
RRQQLRGRLHRPDLHSGNDRLRRPRLRGQWRQQQPALPEAGERQRDPRLPALPGCRLLPGLGQRGTRADHRQLSRQHPDLHGIRAPVRGRQPAVRRQLPRYRHRHPFVLSRHGGSHAQSTPTSPPRPLACGAAGAVPGRPGTSRQCGADLADQPGHRSRPTGHRAVAGESRQATGDPAGARARLVPGGFPGRLSQPAGSDSQPALRQGRAGPPAAGPADPPGRPAQHAGGRLSGADRRSARRQRGADATKPRSRPAVPDALFGAAVRQRRRRLDPAAQRCRARPGRRDPAEAGLAAGRGTGQALPAGAQRG

SEQ ID NO: 30755 - protein, 123 aa, Pseudomonas aeruginosa
STAATAARWCRSTPPMAITCSTPRPCAKPACACLATPPDRSRWTPCPRSGRTMTAPASNCTCKCRRTGCRSSASTIPDWSPAPRRAAASARCSTTTCTTRTPPTAPRPGFPRCSSNACSTASG

SEQ ID NO: 30756 - protein, 289 aa, Pseudomonas aeruginosa
PARPRSEIRHEPPLHVRLPARLRYALRQPVAARRLHHQLRHRQFRQPELVHRGQHRPDHHRHHRLQVHRQPVVDPQHQHHRRDHRQHRQSAGHHAAAVQRRQRHLPALQYLQGQRLRHRLQRRLDGTLEQHHLPRHPRPVQRHRRQPAAVPAHRHRGDPAGRHLYRYHRPELGLAPVRGGHRPSLRIRRRHRQQQRQRYPDGAQGLLHRQRSGPQLRQRRAGLGLHRGEPEHWRALHPERHLYHRLRQRQQLQRRLAANAQRRQRDPVQPLQTGRLDGLDHQQHPGRHR

SEQ ID NO: 30757 - protein, 539 aa, Pseudomonas aeruginosa
LRRQTAGRGHRAPHQHAEQDQAAPAAVVGHASERDTAKGVEQGEGQAHQQAHFRIADGQVAADRADQQVEDLPVDEGQHIGDHEDRHRGPGRKVGGIAVIVVMHAEVLDAAEAADAKGGSTGRISRQHPGLYPGQGTIELLNAGSGFRRMTARSFAAACAQSLSSISRAGRGSGADERQMSTSKPSYRAAQRIMNRLSERPGQAPAHLGQGADPGGVVVEAGNQHQVLAAGTDELLAAAHADFLQGLDAVGNERRTHHQQALHPALHQFVELGVGIGLDPLGAPQARLERHRPAPLLQAGALGEGLGGAQALAAVAEGEGFGADVAAVLGQQVVGRILHQLADVPLGQAMEAQQQMVVGLLQVRTHAFHQGIEVYRLVVERRQRADLQAQAMGGDHPAHLLFGGGRGAVGELRIQRRQGHPPDTAARQVEQDLLDGRLAVAHRQFHRPMRPVRLHRLLQATTEDDQWRPFVPPDRAVGVRRFGRTLDQDQRHQQAPQRPGQVDHVGIHEELVEIAADILHPGRIRGAQVEQQQGILGHA

SEQ ID NO: 30758 - protein, 213 aa, Pseudomonas aeruginosa
SGNRRPRKPPSGASTRPVRNSTTRVPSFSASRAICSQARHSSLAKSSPAAAPSSVTGRSPLSPYQPTAEPDNRRSGRCSRASSHSTRRSVRRTRLSHSSALRLWLQGLSAIGSPARLTTASSGWSPYSSKRSMPRTPTPHSDSTCCGRRLNTVSRCPACRQRAHRRRPIRPVPPVKRMCMAVSSFSLRALSVWTLDIDLPDDRASSPHSGVIL

SEQ ID NO: 30759 - protein, 451 aa, Pseudomonas aeruginosa
MEDPSAPAGEPWRRFRLSQGTGLASHWCLSERRQPSILQITRLILPNGTSEGSTGQEASRAPQARHRRDARCASKHAQYCTLNQACTRNLIRLSRRYTTREACHERPHRHHRYWHRRAFRRPRIEIRRPDRTTVRQGPRQRRPHGQQAQRGRHAGPRRAILHRPRPALPRRLATLARGRLGGRVETRSLPIPRRPAEPLPGRAATLGRHPADECDHPRPAHRSASGLLLPHHRGLPRQAALAPAGLRGTEPRSVQPGPDRHPRSPGHAAAGQRAETGGHRRERGHGADLGGGAGLPRGTRHPGAGLLRARQSDRLAGLQSQQAGARHHPRHLGAARHQPVEPAAHRHGQGGRGRAPALRLRRSDRLRRTGSRLQHRPPLALCTPGGGPPVGRPRRSRPGHLRLRRLVLQRPRRRRLAQRPGSRAAPAGTSLRGSGRRLAARCDKKISIQIH

SEQ ID NO: 30760 - protein, 341 aa, Pseudomonas aeruginosa
DVSYDRLAVELRANLLSPRETTPMHESHPSLTPRLGISACLLGEPVRFNGGHKRSALCEELARHVEFVSFCPEQAIGLGTPRPAIRLEGTPEAAEARSRDGLAVGGALAEYARRVAQRADTLDGFIFMQRSPSCGLQRVKVYPEGGGAPRAEGRGRFAAALCEALPELPVEEEGRLHDPVLRENFLTRVYAHAHWQALRQRGLSHSAIVAFHSRYKYQLLAHSPEHYRSLGRLLGEAGHYQPEALGTRYFGELMQGLRRCATRGSHGNVLLHLSGYLKRDLATEDRRELRELIEQYRHGSVPLVVPLTLLKHHFRRHPHAYIAQQAYLQPHPTELGLRNAL

SEQ ID NO: 30761 - protein, 302 aa, Pseudomonas aeruginosa
DFPMNSPHLERGGLPIREVTRLTGVHPVTLRAWERRYGLVVPQRTGKGHRLYSEEQVERIRRILVWLERGVAISQVRALLERPEETPAADVESPWERLHEQLLDAIAALAERRLDDLFNQAASLYPVATLCEKLLQPLLQHLERRWQGQFGARMERAFFFSWLRSKLGARLYHQQRLQQGAPLLLVNQSELSLEPNLWLCSWLLGSGEVPLQVFDWPLPPAELALACERLEARGVLLYASHRLNPEHLPRLLAGVSCPVVLVGPAVEIQREAFETLALTGLLLASTPLEARRLLGERGLLNP

SEQ ID NO: 30762 - protein, 317 aa, Pseudomonas aeruginosa
SNDSDGRRARISRNTLSPPTPESKTPTAADSTAMALPADGTGRIATHPQFAEARAEGVHQQQAAHQRFAETGQQLERLQRLQATDQPHQRTDHAGLAAGQLGLAAVPVEAVVAGAFVAAGIEYRKLALETDRRAADQGLAGAHAGDVDRLAGGEVVGAVEHQVDRRHGGIEGVLVQRGAMADQADLRIQRAQPAHRRLHLADTDAGAIVDDLPLQVGQVDRIEIRQVQLADPGRGQVQRHRRTQAAKTDDQCAAALQAQLALDVDLRQQDLATVAQQFLVAQHAHCPRVIRSLPPRSRNVCTPAKPRAPSSSRTAAP

SEQ ID NO: 30763 - protein, 512 aa, Pseudomonas aeruginosa
ATGSPLRRRAIQSSNRSLASRGTMRSGQVRRKLRGLPIAAASSNSVSSRALGESGSWESLRRVQIVVMSVAQGRQLIGLVFLQQRLDHLFHRALHHLAQGVQGEVDAMVGDPPLREVVGTDALRAVARAHQQLARAGDRLLRRGLLLVVELGRQPGHGLGAVLVLRALFLALNHDAAGNVGDAHRRVGLVDVLAAGTGGTVGVHPQVGRVDLDRCLLVRLRQHRDGAGGSVDPALGFGFRHPLHAVRAGLELELGVDVVALDPGNHFLVATVLALVLRQRLDPPALALGVARIHAEQVAGEDRRLVATGAGTDLQEHVAAVVGILRQQHALQAVAEGGEAAARFGDLLLGEVAQLRVAVLEQRLGALEIGLHLAVVAERQDHRFDLGVLAGIGAEAGLVTDHLGVAEQRRQFFVAIAEDIQLFQQRSFHAGIGTGQWRGAPSSRANSSWARASASMRPSADIFFICTLGACSSLLVRPRASWAITSAGSAPLASCRWALPSSSSRRRSACCR

SEQ ID NO: 30764 - protein, 170 aa, Pseudomonas aeruginosa
TSSSSPTSGSMSRGTAMSTMNIGLCLRCFSARSTAPLPRIGNWLAVELMTISLLANSSGISESSTAWAPNCSASRLARSRVRLATTMRFTPCSNRWRATRVMVSPAPISSAWLRCRSLKICLARLTAANATDTGFSPMAVSVRTVFAVLKVAWNRRPSSGPTVPASRATA

SEQ ID NO: 30765 - protein, 160 aa, Pseudomonas aeruginosa
SAATMPCRCSRPGSRNTRTTSACASPTRACWWSRTAWTTPRPSSPDWSSNSPTTTTCVSPWRWSAWKPRPGTKPGSTWKNWSSATATSTPPTSTSAASPRNRRTPRVPSTSTPRSARAMTSSRRNCARPTSCSRPVASTKPPSAWTRRAASNPTTASSCT

SEQ ID NO: 30766 - protein, 213 aa, Pseudomonas aeruginosa
PAPRLLETMRLRLFLAASALALLSGCAGLTSHEALEGQGDAQTWKTHKQQLSELDAWQIDGKVGIRAPRDSGSGTLFWLQRQGYYDIRLSGPLGRGAARLTGREGAVSLEVAGQGRYQAESPEALLEEQLGWRLPVSHLLWWVRGLPAPDSKSRLTLDADSRLARLEQDGWQIEYTRYAEQNGYWLPERLKLHGQDLDVTLVIKDWQPRQLGR

SEQ ID NO: 30767 - protein, 199 aa, Pseudomonas aeruginosa
RGAPVVTAVQLIVGLGNPGPEYDQTRHNAGALFVERLAHAQGVSLVADRKYFGLVGKFSHQGKDVRLLIPTTYMNRSGQSVAALAGFFRIAPDAILVAHDELDMPPGVAKLKTGGGHGGHNGLRDIIAQLGNQNSFHRLRLGIGHPGHSSLVSGYVLGRAPRSEQELLDTSIDFALGVLPEMLAGDWTRAMQKLHSQKA

SEQ ID NO: 30768 - protein, 213 aa, Pseudomonas aeruginosa
RGEAPGAQLPPADQQAGDVHRQRRRGRLREQPAPGCGEGHRRGRRRGGGAGVQQDRSRDRRAGRRRREGHVPRVPRSRGTRPEPCDPCRLRPAQPADLLHRRGEGSPRLDRPRRRHRPAGRRRDPHRLRERLHPRRSGRLRRLHPVQGRTGRQGSRQMAPGRQGLHRQGRRRDAFPLQRVIPFPSQESPGQAPGLFVPAPPHRPLSGDPTPSV

SEQ ID NO: 30769 - protein, 106 aa, Pseudomonas aeruginosa
PWSTSSVVINYFDFFGTRIRPDETDTPLVIDPDAMLARPLSLQRLQPVSRWRAQVSKLRTRMKHCELTRSDCEDRSPPPRKTRLKKLTSLVAAKGQNHSLTLNVKR

SEQ ID NO: 30770 - protein, 332 aa, Pseudomonas aeruginosa
TGQAGPLPGHRYRQPRLLPPGQLEGHRRPDPERRRAAPVDEHRRQRLRCGEPADPHRQRPRQDRRRGSGREQGLRRQPGQRRRHLQAEPATTGLGQLQRRLRAAGSGQVLRFRTLRRSRRQWPLPAVAGGQRERLAAGRDQDQAGRAGLAAHRRCPGYPGGGVLFLVGQEHQVRLEDPGGAAAGHQEAQLRPGGPGYLLAGRSLAGRRQRPGHPLPGKGRRPLAEAGRDLGQPVQGRRLRRLEGRPAQPAPAGRAHLQPERRAGQQDRRLRAVRPARHPGAAGGHPHRGHPEPAGQGLHHGLGTTRAGLLRRARTSGTVRLQGTGADLQPDV

SEQ ID NO: 30771 - protein, 250 aa, Pseudomonas aeruginosa
SCQQACQAAASSARRGQSGCSRSAKSSRSSQSRPLRRSRRKARSVSARRCTASKRHQGDSCTASRGWLSTAAPEAGSKDSGWNSPRHGAEVPVAASNGPSSRKRATRLAVVCEGRQKLPACMHTWRLLWRRKWSPRGPWWRSAANSACQSGSPGRLSRKRWLIRQRRCAPPTQGSRRVSKTRAKWKSPRPSQQPWRRAWSSRSRLHRSNSWPRVRALEMAQRSTFFAAHRLPAVSSTQASPGSAMRKLLS

SEQ ID NO: 30772 - protein, 165 aa, Pseudomonas aeruginosa
GLPGLARPRLRPDRPPAARGTGCPRRPRRRSGSPAGRPTTGSGYARSPPCARRRSSGRTPGPPAAPGRGCRAPAAASVPVRRSAAGCPAGRRRAAGRAAAGNPDRGWRRVRRWAVRPAGCRSPPAAVARRSAAAGPGPPATRPGPLRPARPARLSSPPGRPASAG

SEQ ID NO: 30773 - protein, 513 aa, Pseudomonas aeruginosa
PAMHGWPPAPLTRLGKASSITSAVSGKVLTTRPSSSWVVSTEPLARFSLNGKLRRPRVTGARVLPLLLPVAATYSSFTVIGTFCPVAVLVTPLIAMVALLPSTMALSRTKPMPAPCTSDSCSSSSAVISAWAKGAASRAASRQARLISAALVQAAQAGVLPWNAIEGLTEVDLDRRRSIGVARHVEEGTGQRGDQLGGILLVAPLDVLALHRDEEAFRRVDEVLRVVRIHGADRERLVLGQVEASLGAHQLAVVGGQEGQQDVHQAADDGAVVHVQGRAVLQADHGSADRVGVAGAVHQLCLGGVLRAAGESDGGLRRQAVEGQQAAGNAASQLAAGAVQVHRHVAGEGLDIAREVALGFAETDTDADHLAAVVGELDVGIADEERVDRAGGVVDRAQGEVVDGDVGTAGKLAAAVVLAQLQLLHVQLGLDVGAEVDAGEVQSVGGVGGEVDEGLADHVGKLVVVQRLHPRLGGGSQQTGAAEQRATQQEGQTTGHGLTSCSSRGRRQRHCDL

SEQ ID NO: 30774 - protein, 170 aa, Pseudomonas aeruginosa
PVAPPWRWRRSGARAWMPCRRRRCRCSPGRRAPSSAPPRRSRATSSPSPASSRSRRSSPSPAARARANGPARPPRTAREMIERCQAALPLPDLMQWLLAQEPDGATDELLYWFSRLSRDARFQRERLQRREYETTEHCVSLCSFALTPAAKDKGQARDADTLSASETHAS

SEQ ID NO: 30775 - protein, 189 aa, Pseudomonas aeruginosa
SLRTDPARADLPRAVQGLPHQPPRPRAVHPAVLAPGPVPRPVPRHGLRAGLRHPRLLLLRPGAGRRPGEQDRPTPGAVHLHPRRTPRRPGPRPAVRAGRRQHRPRRAAAAAGEIPRPVPPGRGADPGRTGREGHAPPDPARLRLRGQRRVPLHAADAPFPRRLPVGAAGPQPVRQPARRPAVADAGAGR

SEQ ID NO: 30776 - protein, 949 aa, Pseudomonas aeruginosa
RMSQTRYGIRRFALLNTAGYSLGIFPLENPLSIYGANNLGKSASINALQFPILARLSDMSFGKYSMEQSRRFYFASDTSYILLELMLPHGPHVIGVAGRGPGGGFGHQFFAYAGELSLDHYQKNGTCLRQRELFANLEREGFKAYEVKPEELRRLLVGGHTSIPLDLTMIPLRSTSEQSLKTFRSLFINLLHMREITAAKLKQLFLDAFEHSLRSGNVDYIAACEEAFRDVRRMEQDYQALVAAGPLVEALANGVTQRDVLRGKMHRLSPLLDSLLGTWHDYAGARREELLIQHEQYRAEQDGLQNEQRGGTQELMRLEREIAGIQRWLGELSVLKTRFALVDDAKVLEQQLLAAKDAHDELAGALAHSRQFSSEDLEERLRDLEKRLKNVRQQLEHADNNSYARLREEFSQQDVERLMRLFNGALFSLPLGENGVNLDDGDVWVKSVEAILDHFKGEHFEAPGLSIDLSHIEPPALQALADRAALRDQKERLEKELKQLKTQQSVAADRAASKAQAEKLYQDVLDAQKALEDFRRTQTLTAEEPEKLAELAQLEASQDELKRSSDAFAERVQQLSARLQLVARQLGDLEAKERTLEDALRRRQLLPADLPFGTPFMEPVDDSLDNLLPLLNDYQDTWQALQRIDGQIEALYAQVRLKGVAKFDSEDDTERRLKLLINAYAHRQDEALTLAKARRAAVTDIARTLRNIRSDYDNLEHQLALFNREINKRQVSNLQSFRIVLAPNKDALKHIDQIIHSAGQYEEGENLSVFDLTQSAEQDAKNEEAKEYLARLVAANHNQLGLKDLFELAFEITKVNGQPIMHTDIDGAASNGTTMTIKALTNMYLLLHLMDREQAGRVRLPYYLDEAADIDERNQAALLETSLQLGFVPILASVKPQVSAHVAIDLEGGSGPNGIYIDEADWKYIRRRDAAASGETRAASEPEEAGEPA

SEQ ID NO: 30777 - protein, 356 aa, Pseudomonas aeruginosa
ARSSREDIIGYIRICNPRGESMPVRLLNRFRHAALACLLGSLSLNAAADPVTLTLYNGQHAATGIAIAKAFQDKTGIQVKIRKGGDGQLASQITEEGARSPADVLYTEESPPLIRLASAGLLAKLEPETLALVEPEHAGGNGDWIGITARTRVLAYNPKKIDEKDLPKSLMDLSDPSWSGRFGFVPTSGAFLEQVAAVIKLKGQEEAEDWLTGLNAFGSIYTNNVTAMKAVENGEVDMALINNYYWYTLKKEKGELNSRLHYFGNQDPGALVTVSGAAVLKSSKHPREAQQFVAFMLSEEGQKAILSQSAEYPMRKGMQADPALKPFAELDPPKLTPADLGEASEALSLERDVGLN

SEQ ID NO: 30778 - protein, 140 aa, Pseudomonas aeruginosa
RSGSRWPRATAGSPRPRWACRSVARKCCSSPCRVPGARHRRAGPASRPGWRAALPGRTPADRPGCPSPPGSPSAPARNCPVRCRRRRPAPARSARGWHCSRRRWRGRSPPAFADRSRPAWPPRKRRIAACRRPAGAAARC

SEQ ID NO: 30779 - protein, 123 aa, Pseudomonas aeruginosa
PCANPAAAATVASGCCTWPATASPSGVPTCPPATCSGAWKTNTPGGCSGIPRGARRCSTTCRPSAWNRCATATGSFAGSTTARECGSACCRESAASWRSSSCWSASPCTCCCACTASNRACAP

SEQ ID NO: 30780 - protein, 595 aa, Pseudomonas aeruginosa
FDPRPLRCRTLCRDGAGSPAPGRAHRADRLRELHQPGGDGSPGFGADQQVRRRLSAQALLRRLRVRRYRRATGHRPRQATVRRRLRQRPAARRLPGQRRGLPGPAVGRRHHPRHEPGPWRPPDPRRQRLLLRQAVQRCAVRHRRQWPDRLRRSRAPGRGAQAEDDRRRLLRLFPGPRFRPLPRHRRQGRRLPVRRHGPRRRPGRRWRLPEPGAVRRRGHHHHPQDPARSARWPDPGARQRGDREEAQLRGIPRRPGRSAGARDRGQGGVLQGSPAAGVQDLPAAGPEERPDHGPGLPRPRFRRSFRRHPEPPVPALPDQAGHHRQRRRRRPRPRVHHREQELGPERPALAVRHLRPAHRYPGRDHPRLQGSRVPRAGRLDLRHPREHGRRVRGRRRTREGQGDLRQVPGLRQLSDKARRKSPANAGLFHFLRGRRRRVALSPVLDMDHRQGLGILAPPGAAVHADEQLAGVLLQFLARDEGKDVRVMPGHHPAAAVVQGDHTEVARRRADLYRSPLGQQCPRLGREVRLRLREDHASALGEQHPGFVRATDAVPPGADQCVPVHFHAPLASMRLSGLRRCVRSPRGYCPPAGCRR

SEQ ID NO: 30781 - protein, 798 aa, Pseudomonas aeruginosa
RGSGRGCRWLLRTCATSRKDAGHVRRGPRKDGDSAAADRPTLAATVARLLALAEELLVGHHRLVRVLVAHVLDIGVVVGHADQHPGGLAQVFAHAAEVVEHGEFLVKAPRRTGERGRSGVGDGLERGFLVGPLALAPGRDADLDGVEQYAEHHQQEQHGQTGVDVGVQHHVLHLADILGRRQHLAGIQRGGVLLAKSDEADRRVAVEDLDQARGGGADQQPGRRQDGDPDILLALHLDQDHGGEHQRDAGEHLVGNAEQRPQGIDPAQRVDHALVQQPAPQRHAAAGADDVGGPRLGLLQRRHEVAQQVLQHEAPGTGAGVHRGEDEQGLEEDREVVPEGHGVLARQHLVEDVRDPHRQGRRAAGTGQDGGLADVLGGLGELLRRDGEAPAADGRGHRVDVGADHRRRAVHGEVDARLDHRGGDHRHDRHEGLHQHAAVADVAGVGLAVEQLRRGPRGDQRVEAGHRAAGDGDEQEREQAAFPDRAGAVGELGQGRHLQFRHDDQDADRQADDGADLEEGRQVVARRQQQPHRQYRGDGAVADQHPGDLDSTEGEMRRPFRTGRDLPAEPDRTEQEEHPDDRDLADPAGADEAHVDAHEQRDGNGREDGEHAPGAVGQSLHHDQREHREDDDHDQEGAEQRDGPGHLAHFLAHQLAQRAAVATAGDEQDHEVLHRAGEDYAGDQPEGAGQVAHLRGKDRTDQRTGAGDGGEVVAEEDVLVGRDVVQAIVVEYRGSGAVGVQLHHLAGDEQAVVTVGDQVDGHRRHHDPQGVDRFATTQGDDAQGRGAHDRHHQPGEVT

SEQ ID NO: 30782 - protein, 151 aa, Pseudomonas aeruginosa
WPDKETSMRTLLFLHLLGAAIWVGGHLVLALGILPGALRRRDPQAIRAFEQVYERIGIPALLLQVVSGLWLASLWLPFDHWFGATSVARALQLKLLLLAATAALGVHARLRLIPNLDAESLPKLGWHIAAITLVGLGFVAVGQSFRFGGAF

SEQ ID NO: 30783 - protein, 144 aa, Pseudomonas aeruginosa
RNTGSEPMGLLSEFKAFAVKGNVVDMAVGIIIGAAFGKIVSSFVGDVIMPPIGLLIGGVDFSDLAITLKAAEGDVPAVVLAYGKFIQTVLDFVIVAFAIFMGVKAINRLKREEAVAPSEPPVPSAEETLLTEIRDLLKAQQNKS

SEQ ID NO: 30784 - protein, 467 aa, Pseudomonas aeruginosa
ARQTILPLGLYTPSRANCPARNRNPASRLVRRVNRLGVRGCTSSSVWRVNFSSLAVMVRSGYRYSPSVPQSTRQKHPQGLWLSPLTGIASGRSALAVDHLGRAQHVTTDLRLVVLPQRLHGVAPGLVLFRAEADQAALAGCQQVLALLLVERFGFLVHHQGDLVDDALQFGAGLVGNAGPERRTGDQHVAERAVIGLGDVRLHAVDLLSGEVRPGVLGALHAAGLHGLEGLGVGQLLGGGAEHGELRFQHRRRLDTEDQALGIVRPVQLASGGKLLHAVVPVGQAIDTVLGHGAQQFAALVALLETLQGLQVIEQERQVEHLELLGIGLELGQRGGQHLHLVGAQGLDLVGVAEQRRVGVDLDLDLARQTLLGKLLEQQRPLALGRVVGDHMGELDHDRAGVLGMGDGGNGEQCGERHTDKRLEHRCTCAMATTSPATARTGLVRETGWVTVTARSGEGARPGATGS

SEQ ID NO: 30785 - protein, 385 aa, Pseudomonas aeruginosa
LTSGIRPAGNPMPLFATPFAQLDLVRQPEQDGEPLQAFDAADEYLLNQLHERGVTAQCRVLVLNDAFGALAASLAPHVQVTSSGDSHLGFLALRKNLARNGLDLGSVRFVPASETAVGPFDHVLVKVPKTLALLEEQLIRLHGQLAPGAQVVAAGMVKHLPRAAGDLLERYIGPMHASLAVKQARLLIAEAAERPQPRSPYPTRYRLEQPPLTLLNHANVFCREGLDIGTRAFLPHLPRSLGALRAADLGCGNGVLGIAYALLNPQAELTLVDESYMAVQSARENWRAALGERPATFRADDGLAGQAAGSLDLVLCNPPFHQQQVVGDFLAWRMFLQARDALAAGGELWIVGNRHLGYHAKLKRLFRGVEQVAANPKFVILKAGK

SEQ ID NO: 30786 - protein, 418 aa, Pseudomonas aeruginosa
PHVTLRPPLETPDPSMSSQPSSLLRHRPFLAFWLARVCTASGFQMLTVAIGWHIYELTGNVLDLGLVGLVEFLPRVLFMLHTGHVADRYDRRRIAALCQAGQALVAVAQVLGAASGEITRNMIFVLAFALGTARAFEMPTTQALLPNLVPAGLFPRAVAASASAMQAATIAAPALGGLLYAFGASWVYVPTATLYVLACVLTLSLPVRNQPLTQGKATLDSLLAGIRFIRSRPDIFGAISLDLFAVLLGGATALLPVFAKDILLTGPWGLGLLRSAPAVGALAMSFWLAHFSIERNVGRIMFLSVGIFGLATIAFGLSKSFWLSLGVLVVLGAADMVSMVIRGAFVQLETPDEMRGRVSAVNGLFIGASNQLGEFESGLTAHWFGTVPAVVLGGIGTLVVTGAWMKLFPSLAQRDRLH

SEQ ID NO: 30787 - protein, 373 aa, Pseudomonas aeruginosa
STPADTALRAPRTDERRSSPTIHAGMPGPSLLRFPIFSGARMDPRSEVLLRQRHLFATPLLLAGLPADDLLAELPQAQGWSWHAGEQAQLDARFPDRSRFDTRAPTGAWTSAVLFLPKSRELTDYLLASLAARLPGGELFLVGEKRGGIERASKQLAAYGKPRKLDSARHCQLWQVRIEQAPAEPDLHALAQRYSLPLTDGELQVVSLPGVFSHGRLDRGSALLLGQLQALPGGHLLDFGCGAGVLGAVLKRRYPASRLSLLDVDAFAVESSRLTLAANGLDGEVIAADGIDGAPRELAAIVSNPPFHQGVHTDYQASERLLQRAAEHLAPGGELRLVANSFLKYPPLIERHLGPCRTLAEGDGFRIYSARRS

SEQ ID NO: 30788 - protein, 225 aa, Pseudomonas aeruginosa
PERQPGPAIAAGAQAAPPEHDRHRRLHRHRAVRRLRGHRGHRRARRCAAFLRTDRADGVLPHDQSRRDGGLHARFRLVLHLWQPVRRRWLRFRPRLELLVQLGGDHRRGAGGSATGDEFLVPRGAGHLLERDLPGHHVRPQRDFRARLRRERILVRPDQGSHGGDLHRRRPGDHLRHHAWRGVARLQQLHHGRRALRRRLPGDGRGGDDRRLLVPGHRTDRHRRR

SEQ ID NO: 30789 - protein, 69 aa, Pseudomonas aeruginosa
IGKSAEEHPDRHSPGVLAHPDVLHPGDLRDRHADSLHRPEPAEERCQRHQRIALLPALLARRLPPGGRG

SEQ ID NO: 30790 - protein, 71 aa, Pseudomonas aeruginosa
SSRRSSPPATPACTPRPGCSTTSPSRARHRACSPASRAAACHATRCTPLPWSAPCASSLRPSATAPSTHGC

SEQ ID NO: 30791 - protein, 217 aa, Pseudomonas aeruginosa
HARSDPGRADGACHGDWSTRPLGSLMESLFVPTLIVALAEIGDKTQLLALLLAARFRKPWPIIAGIVAATLANHFAAGAVGAWVASFFSEATLSWILAASFIAVALWTLVPDKLDDEESGLKKYGPFLTTLIAFFLAEMGDKTQVATVMLAAQYPHFWLVVIGTTLGMLIAHVPVVLIGNLAADKLPLTLIRRLAAAAFAALGLYAAWHAAQLTGWL

SEQ ID NO: 30792 - protein, 705 aa, Pseudomonas aeruginosa
PVPRRSRCRPLAGLHPGPAQARRPAALRWRRGNGADRQQRPPGGLHPRRQQARRARRQRPRRQRSGQPEKPHGRPAALRHRRRARPHRAVPAFHHRRQRRALDPHAADSPGGGIRRTAATPGRAERPAPAGYPRHEPGRPGGSGPRPAGGLAGRLRHRPAAAPIGRHARRHRPGRRRPHPPPEQRARRRAGLHRQGLQYLPWQTAEHDRPGGAIGAEGQRLLGAHRRHRHPHQPGRAAATGGDRTGGHRGPRDDRHRPGRGAQRHPRRRGSQPRGPGRAPGQADRRKQLGGDPGPGQRDRPRGRSGAEPGQGQRKHQRDPGGDPRYRRADQPARPQRRHRGRPRRRAGSRFRGGGRRGTQPGAEDPAGHRRNPEHDPAVAAGHPRRGEGHAGQPGAHRRQRAPCAPGGRGAGIDHPGGIGDQRHESPDRQRRRGAERGGRGHQPQRRQHRPGRQPGGRRRRRGLAGQRRADPPGRAAAAPGESVQGLASGRGQALRPVGFRLVDEAGQGHAAQFRLGLGEQAYQRRQRRVRSQPGILLGLVEQQRPAELGGRLGYLGHAEPGLSLHRIGLPDAGEEQQALAGGNPVRTLAHPAPFIEAVGRQQAAALLERLAEHRLLGEGFRPRVAGRTRQVGEPGRGQPPARQVGAARTGVLANHQHLVRRRNVPVRPPIRRKARQGRQRRIPAEQGVTTTHAWHCLVRESRTV

SEQ ID NO: 30793 - protein, 89 aa, Pseudomonas aeruginosa
SESAFPVTEPHPGKRQHRRVVMLETAPHEHNYLIDHLDEIEAVIVDLSFNVQDDRWLVYCTACGHEHLDLPETDERISIGEPDPFHQAA

SEQ ID NO: 30794 - protein, 350 aa, Pseudomonas aeruginosa
RLAGHRQGHPQRRRPRDPGTLRLPRRRRRRPAAPATFRHPGRQGLRWFPGERPVAALRQPGNRQAAPGQGLQPGRGRLAADVRAAPGHPCGGRQEIPAVRPLCRFLHQVPAPWLVPRPAAVGTPGQHPADALGGPRQHGPDPLPDRPGHAVAGTAPGSPAQVLPRSQGRGLAPGSRRPARADHQEGSEERRHPAVRHRAGGRPRRLHRRPAGRLAGRLGDRLDHARPDRALLPGAGPLAGVERQAEGNLPGSRERAGKRRRAVPQRQQPLQRGAGTDREERRAGPGQRRVSRATEQAAFGRLFHLWSQAPASQLIIQDTPKRSTRVPKQGDQKVLPNSSSTRPPSSSKAS

SEQ ID NO: 30795 - protein, 344 aa, Pseudomonas aeruginosa
TAAAGGDRPGDHLDRPGDGADCGEHGDGQGRRRQRVAAVPHRDDDLDAGAAHHPGGGGIRQGYLPPGANHRRRAGRLRPVVRLRRGRHRRDRRRTLAGTAEIHRAGIQLAGDPVHRPGGPGPGHRAYRRGHRGGRRHRPGLPEEARPAPHSPRRRPGHLGCRPVRRTAQHHLRGSHRRSDADQELQPEDHDLGGGDRHHPGLRRQVRRDPAKHPGTGDGRHPLPAVRHHRLGRHEHPDPAQGRSLGSAQPGDRLGDPGVRHRRRADRQRYRPRRHRPEGHRPVRHRRHRPQPVAAGQRRLAEQGARRTTQGLTLKTTDGTLRCSVHFPPATLFSKACSQSLTTL

SEQ ID NO: 30796 - protein, 182 aa, Pseudomonas aeruginosa
THSGSLVVLCLRQPAGHRPGRRYADRPGRRADGHRCRLHHHQRQRQRRYQPVGNPGLRQPFRPYQRGRRADRRHQRQYPDPVQHRPDPEPDGATQACTPAAGHATCRTPPPPAAPSPTTSIRKPRASAADPGQHTGWTFPPVSTGHRSQNPPYTAGWCPPGKARPRGRRGRTRTPCLVTIAW

SEQ ID NO: 30797 - protein, 311 aa, Pseudomonas aeruginosa
RRQRWRDHLRHPRLRPVRLPEQRHQRHQPARRRLHPGQVRQRPDLCDHARRRALRQRRHAAHGEHRQHRPHPDLQPVQRPPRRHRLGQHHRRCRHRQRQRPVVSHLRPGAGTDHAGRRDLPRHRQRDHQLVMPMSSRRLFLSLLLLPLPNLVAHADPSPISRAFQVQAVVANGCAFGTAISNNAYDLGTLSFGTLGNLASPVNVASSSGAGSIVLTCTPGMTVSVALDYGVNGGSSSQRYLKRVSGNETLAYQLYQDAAYSQVWGNGALARTIANFPASTQTYTVYARLFAVGSLPSAGNYRDTVTVTLSF

SEQ ID NO: 30798 - protein, 268 aa, Pseudomonas aeruginosa
AVMEDHMPSPHLPLRPGRWLAALLALFLGGPAQAASAVLIWPINPAIEADQPATALWLENRGKQPVTLQVRVLGWSQADFQDVYRNQQAVIPSPPFVKVEPGRRQLVRLIRQGGQPSTPEDAYRVLIDEVPDGSAGQTQRSPGLALQFQMRYSVPLFVSADGVWTQPRSDVERDPADATRPKLAWRLVEEQGKRYLQVRNEGSVHARLSHVRWEGNGRSLALLDGLLGYVLPGQQMRWPLPPGLLPDAGMTLKLQLADNDAPISVPGY

SEQ ID NO: 30799 - protein, 997 aa, Pseudomonas aeruginosa
QRQPATAPASAAGLAAGAALRRSRTGRPRPGAQQPRRAVQLRPVLLGPRRRRHALAFRAARATPVRRLRGDLQHRRLHPLFRRRRQPRQPLPALRHLLAVQRRTQHAQLPTGRLRQRRAELDHPGTHGRLSLRPQLRRTSGPGHLSAAALRRPGRRTQHRRPVHQRLQGQQRRPATRSLRHQQRAVHQRSRRSHGGDHRRPGSTSGDQPAVLRIQHPAGARPERFRPVRRAPARRLRPAQLLLCRQRRQRHLPLRRQRPPDPLHPRRGRQRPAPARHRRRHRRGHLRHPQPGGQRQRRPGRQRPAIPARLLLLFATARPQPATHRAQRRLWRPRHPGRRVPVEPAHRPGYRQPDLRRAGHHRYRLLRHPRPRRQPHAPGQPLLQPPDRQPQQLLPGAEQGSRRRRLQRADATGDSLRHQRPAEHRRHPRQRPTVQRAGDLEPLHAEPGRPRLEPRLWRRRQPLPAGRPDLAHAERATAGRPLWRDRQLHALGRSQRLAGMDGQRRVRQQPDQRRLRPGQHQGLSTGADPLREPTDGQHRRQRPPAGALGRGLLPGEVPDRAAGPSGQRQRARSRAARGGTPGQRPAAGFPDPCRSRRQHQPGGRARRTAAAGQPGRRNRQRPARQRRLGRPGLFRRIAKRQPATRGPPRRPGLPGTLPPGHAQTHRQPGRPADLLGPDRRYAMSRHSTSACLLGFATLCASPLLLAACTTSSGTGNFGSLSSFTVASTAQTITGTTGFKCTGSLLSILSTNTIDATIASTANPLGTTPRLYNAASGTYLPYSICKDNGCGTVYNVGSTVRWSSTTFLGILGLFNATDGSLPLYLRTATGVTLPAGTYTDTIGLNWAWHLCAAGIGPVCVYDDGTASSSVNVTLTVLKDCFIDSAPDLSFGSAALVSAFTAVNQNIGVRCTLNATYTIGFDNGNNFSGGWRRMLSGANAIQYNLYKPGDSTVWTTSNTQAGTGSGAAQNVPYRAIVNPAQGNVPAGTYSDTVRVILTY

SEQ ID NO: 30800 - protein, 340 aa, Pseudomonas aeruginosa
FACPDATQPERHVMSVPIAIIGTGIAGLSAAHALRSAGQTVQLFDKGHGSGGRMASKRSEAGTLDLGAQYFTARDRRFLDALQHWREEGWVDEWKPALYQYRDGQLSPSPDEQPRWVGIPRMSAITRALLTDLQVVFSCRITEVFRGKQHWHLQDSEGQNHGPFNQVLIAIPAPQATPLLASVPKLAATAASVVMEPTWAVALGFREVLDTPVQGCFVHGSPIAWLACNRSKPGRDTTLDTWVLHATSQWSRQHIDMAKEDVVEHLRCAFAEVIGCAVPEAAFSIAHRWLYARPAEAHQWGALGDPDLGIYACGDWCSSGRVEGAWLSGQEAARRLLEHL

SEQ ID NO: 30801 - protein, 221 aa, Pseudomonas aeruginosa
RPDSASAPACSANRCASTAATSDPRFARNWRDTSSSSPSARNRPSAWARRARRFAWKALRKPPRRGAATAWRSAERSPNMRGGWRNGRIRWTVSSSCNARRPAGCNGSRSIQKAAARRAPKAVDASPQPFAKPCRSYRWKKKAGCTIRSCGRTSSPACMPMPTGRPCASAASAIRPSSPSIAATSTSCWPIRRSTTAASAACSAKPATTSRKPSALATSAS

SEQ ID NO: 30802 - protein, 123 aa, Pseudomonas aeruginosa
RPVRRWRSGRARRRNARSSEFRWWPGRRPDRCGWPPRPASPQAPWPPAAPADNVRAIPPQPQPSRYCRPVPEPWRPAPEGNHRSARSVRGCTPRSSRRRAHGRCRRRRATIRMAGARESHAIR

SEQ ID NO: 30803 - protein, 161 aa, Pseudomonas aeruginosa
QGLSSRRVSNTESWPSRRIAAPLTRGLPARTQATLTASRVAKLSVQSSTRSTAATAASRESLSSAALWLTRRICGFSAPSRRIADSTLPTPTLVPSWMTCRCRLVRSTVSKSARCSSPTPAAARYSATGEPRPPRPTISARLRFRRSWPSTSTCASRIWRL

SEQ ID NO: 30804 - protein, 388 aa, Pseudomonas aeruginosa
PHRQLRRRPSRPPWACRTAYVMMAPPSQVQGRLSSSMNKSLALLTVTLLLGGCQSLIHKTPDGTPPVEDTAVETKAKPEKYGSFSEDSLYSLLVAELAGQRNRFDIALSNYVVQAQKTRDPGVSERAFRIAEYLGADQEALDTSLLWARSAPDNLDAQRAAAIQLARAGRYEESMVYMEKVLNGQGDTHFDFLALSAAETDPDTRAGLLQSFDHLLKKYPNNGQLLFGKALLLQQDGRPDEALTLLEDNSASRHEVAPLLLRSRLLHNHEAQRRCPAAAQGRDQGTPGRQARAPRLRAPAGGAEPPGRRQGRVRRTGPAIPRRRRPAFLPGAGLPGSPGLGRSQDLPGRTGRARQPRRRRPLQPRPPRRGTEGHRACPRRVRPGRPGQ

SEQ ID NO: 30805 - protein, 245 aa, Pseudomonas aeruginosa
LPPGATAPDRRPAQGRSRRRSRPAPGQGAQRATRLRHPAVPDRSRGAVQQRPAGKGLAGHPGGSEAVPGGPQPALHPLDAGGEAQRPGADGKGPALRHRPRAGQRHGPQRPRLHPGRPHYPLHRGPRADPQGAQAEPGRPGDPRQHGLDQLSPGQAGRRRALPAPGAAALPRPRGRRAPGRSPLGPGAPGRRPGHLARIPRQAARQRRAAPHHQAPDRRRDSLKPCVYVFSSPPPRWPCSAAAPA

SEQ ID NO: 30806 - protein, 294 aa, Pseudomonas aeruginosa
SRTGSRASSAADMSVRLSLPAPAKLNLFLHILGRRDDGYHELQTLFQFLDHGDELHFEARQDGQVRLHTEIAGVPHDSNLIVRAARGLQEASGSPQGVDIWLDKRLPMGGGIGGGSSDAATTLLALNHLWQLGWDEDRIAALGLRLGADVPVFTRGRAAFAEGVGEKLTPVDIPEPWYLVVVPQVLVSTAEIFSDPLLTRDSPAIKVRTVLEGDSRNDCQPVVERRYPEVRNALILLNKFVSARLTGTGGCVFGSFPNKAEADKVSALLPDHLQRFVAKGSNISMLHRKLETLV

SEQ ID NO: 30807 - protein, 234 aa, Pseudomonas aeruginosa
TKTPRSGGAFEIARTLVASVRAHCYFWRYTMVDFILNAQVRSDLGKGASRRLRRNAGLVPAVVYGGDKEPQSVTLELREIAKLLENEAAFSHVIALNVGGAKETVLIKALQRHPAKGFVMHADFLRVVADHKLTAHVPLHFINEEVAVGVKQAGGEISHTISEVEVSCLPKDLPEFIEVDMAKVELGQIVHLSDLKAPKGVELVQLAHGNDLAVANIHASRVVKEEGSEEGAAE

SEQ ID NO: 30808 - protein, 375 aa, Pseudomonas aeruginosa
RLSEREGHSMGFNCGIVGLPNVGKSTLFNALTKSGIAAENFPFCTIEPNSGIVPMPDARLNALAEIVKPERVLPTTMEFVDIAGLVAGASKGEGLGNKFLANIRETDAIAHVVRCFEDDNVIHVSNSVDPKRDIEIIDLELIFADLDSCEKQLQKVARNAKGGDKEALAQKALLEKLIPHFTEGKPARSLLKNLGDEEKRLVRSFHLLTSKPVMYIANVAEDGFENNPHLDVVKAIAEEEGAVVVPVCNKIEAEIAELEDGEEKDMFLESLGLEEPGLNRVIRAGYGLLNLQTYFTAGVKEVRAWTVRVGATAPQAAGVIHTDFEKGFIRAEVVAYDDFIQFKGEQGAKEAGKWRLEGKDYIVKDGDVMHFRFNV

SEQ ID NO: 30809 - protein, 756 aa, Pseudomonas aeruginosa
LCRPSKQQQLGNLLMPRSIPLRPAPLALSLSLFASFSAPALAADPVEQQMVVIGSRAPTRISELPGTVWVIEREQLDQQTQAGVPLKEALGQLIPGLDIGSQGRTNNGQNLRGRSVLVMIDGVSLNSSRGISRQFDSIDPFNIERIEVMSGASAVYGGGATGGIINIVTKKGVGGDTRFNTELGARSGFQSHEDHDLRAAQSISGGNDLFNGRLAIAYQKNGAAYDGSGDQVLTDITQTDLQYNRSVDLMGSLGFTFANGHSLDLGLQYYDSGYDGDRGLDLGRNFDALRGRAPYSIKGGVDLDREPESKRHQFNATYHAPEVLGHDLYLQAYYRNEKMAFNPFPTIRYSNTGAINYGTSYYSASQQDTDYYGMKLALVKTWERASLTYGVDLDREKFTSDQMLFNLPLAAASGGLVASEQAKLGRYPDIDTDSRAFFLQGSWKATDDLTLSAGVRRQSMSTDVSDFVAANQQILIANGLGKTADAVPGGSKDYDVNLVNVGAIYKLNLQQQVWANYSEGFELPDPAKYYGFGRYGAADGNGHYPLLQGVSVNDSPLDGIKTKQVELGWRHTDGALDTQVAAFYSWSDKSIKYDSKTLAVLQQDTKKRNYGLEGQATYWLDDHWQVGVNGLAIRSQEKVDGRWLKQDVTSASPSKAGAFVGWKDDQRSLRLQGVRTFNLNDEPGNKIDGYALFDLLGTQALPVGTLTAGIQNLLDKDYTTVWGQRAQVYYGGLAPAGLFDYKGRGRTYSLTYSVEF

SEQ ID NO: 30810 - protein, 244 aa, Pseudomonas aeruginosa
SRPRQFPCPSRERGTRGKELPPLSAATAQRTQAILRRQLVEAADGDVEVLPQAILDPVDAAMHGQRLAAVPGVLDDAGVADVGHLLDHVELTEAIDALFLGRQLLQVLAVFVGEVANAAQPAVDQAELVVVQGGAHAAAAVVAGDQDVLDLEHVDGELDHRQAVEVGVQHDVGDVAMDEQVAGQHADDFVGRHPRVGAADPEVLGGLLAGQLGEEVRVFLLDRFGPADVVLEQLLQVAHGMPLV

SEQ ID NO: 30811 - protein, 191 aa, Pseudomonas aeruginosa
PDAIRRYRARTCAADVSTACIALIGGVCVARAFAVQSALFPRTGPPDDRPPTRTACACRTLGPARASLRALRCRHPEPGGTAQPVEHPVTGKQPGGNHRPARPVDPPGYPGPGGQEPQPFRAERADPRLPRLPAPRASPWSVPGDRGLPAPSGAPRRVHPGRLRDPRQPGPGAPAATARHARARCTEEARQ

SEQ ID NO: 30812 - protein, 196 aa, Pseudomonas aeruginosa
RAGTDRRGRAGQDQRPADSPGAALRGGPGDLGRVRRADDPAGQRRRRLRAGRAAGRTGPAAPARRTAAPRPPGRRRPGAAHPRAHPRDADQRPADPAPRPRIIAAAARGSAPAQRGDPWRRPGAGGDPAQGPGCRAAGGDAAVHPAAEHLPRHRLAGRELRLRPRPLRAEAGAVPQVQRHAQEPTGRRDHHGPRGK

SEQ ID NO: 30813 - protein, 252 aa, Pseudomonas aeruginosa
PPPPRTRARPGTQTPFPRAKPMHLDLSELTQLAPIFRELFKGYHISHRDPELYTQLSSHQDQYRGLFRAMGFELVCDTRGFYYFVPEQVGAQVNKTAQRLALFTFILVEHLADQGRDPLSVLDGGSIGREELPPLLEKYRDLFLQAEVQTQEELEEKVMRRLTQLGFASEDSGVYRFMPPMHRFLDVCLSVQQDRNLSASLHADLPLQTPVLVDDGEIEPLMASDEELSEESEEDALARAIAEEHAQQEADA

SEQ ID NO: 30814 - protein, 607 aa, Pseudomonas aeruginosa
IDRRRLHARAPAHGLAPANAILAVPAGPAPRPAGQPAAALRRGQGLGRRLAHRLATALAPLRIPLAGQHPVADVRRDPAQRPARPGPGLVRRAQRPAGTALLERGAVPAVRHPRLRQQFHLGFAEPDVRRPRRRHPGHDHVQVSAGLPAGSSDPARHRSFPGGVGADARSVAAPGVPAGHPAAAAPDPGRHRTTGGAAHAGGVRRAVDPALPDLHHSHLPGVRTGVQQRHRGDALLGTPGTVLPAALAGVAHARPRPPGTHRPGQRAAGRTSPPGVRQVAAPGAAGDAGAGRYRYPPGDARLLAVRRLLGQLPADGNRLDPAFLPVAGLRRGPAQLPAGAARKHPGGALPRRPGALDPAPAVPAASVAGTGDRTLAGVLLAALPASHLPDHRLAAGRLCPAVHAADPGTDPRGPGKGLAAVGGSRPHSRPDALDGLPADHPADHLAGHRRRLRAGVPRHHEGTDRHLGARSHRAVDPGHLGLGAHRQPGVRCRRTLRRAADPDLRLAGVPADHPGASQHSLTPTSQQAGMNENAAYPGKRRFFLPVRQSAAGGFLQRNLRRPLQPFVIGRIEQGEGLPRLGGLAHLRIVRGGEGNAALHQRLHRLGA

SEQ ID NO: 30815 - protein, 519 aa, Pseudomonas aeruginosa
RQTLEQAGVDAEAAGIPETAAGTHQRYVARFDEDADQHPVGLFAQGQVDDLAHRDLPVGHQVARLDRALARRTEGQPQAVFPTQQVGCFGESLEACLALARRARRQRLDIGAADQGSEVLGTQQAERRTHHPEAGSAAGDALAGGSQAGLHQYPGEVRVQLDAFDLADVQALEADRRAFAQAVGIVDAQLDFHATGHRRLLAVEEGEATHLGHGRRLRIEGVEGNPAGDQGLQRLALHLHAAEVAGQGDPAGVPEARRGIHQVRVLRLDVHTHHHSLAVARQLVALHAADADLAVEDRRADIDRAELVAGQHQVQAGRVGVQRRRFRADGELATRRAALGEAHVDIVTFHQGLEAGDAGQGDAWLDGPEFGAFQQHVLDPRIHRQVGSGAAVVLAHVDRLDQADLHAVEHHRGAARIDTTDVVHLQLHAQTGLGRVVVVVQAERLARIGRRAVGAVLRGGEGDTAGDQGQQRLAVHLEAGQAAGNGDAAGVPESRVLAHQVGVGRLDVHLDLDGPLVIA

SEQ ID NO: 30816 - protein, 211 aa, Pseudomonas aeruginosa
LEALHLADLDLPVEHRAALLQGAQAIGLEGQVQAGQLVGKGWRLLQRGEVAFFLLALHRIDRDVDAGDQGFQAGDASQGNPRLDQPEAGVLAQVLLGFLLDLDGRDHALDVLADMQVGHLAHRDALVQHLGLVGLDPVAALEANLDVHASLVEGTPRQPGTDGQGHQRQHPDRRPVRGLVFLRTWQITHSRHPDWCCPRSAGGRTSRRRAW

SEQ ID NO: 30817 - protein, 77 aa, Pseudomonas aeruginosa
TSAQCKSRLPCPRKYAARQLSKFFDYRPQRCWLATFPRAKAKPPVIADQGFWDRSLTMTYSHMGRPHTTIGDASFHF

SEQ ID NO: 30818 - protein, 103 aa, Pseudomonas aeruginosa; identical to SEQ ID NO: 21288

SEQ ID NO: 30819 - protein, 89 aa, Pseudomonas aeruginosa
AVDGRCRCLYKTASRSRQAALDRVLSWGYYVVPNYYVDTWRVAYWNRFGRPKVTPLYDWGLMTWWQTSDKALPSKAQAEATQDAEPERE

SEQ ID NO: 30820 - protein, 287 aa, Pseudomonas aeruginosa
  UNSURE (254): Identity of amino acid at the above locations are unknown.
RRMLSYILRRLLLIVPTLFGILLINFIIIQAAPGGPVEQMIALLEGFDAASGGASGRISGGGGEVAVAGSQYRGAQGLDPELVKEIERMYGFDKSAPERFMIMLKNYLHLDFGQSFFRDAKVTDLIIEKLPVSISLGLWSTLIMYLVSIPLGIAKAVRHGSVFDIWTSSAIIVGYAIPAFLFAILLVVLFAGGSYWDWFPLRGLTSRNFDKLSLGGNVLDYFWHLALPVTALVIGDFATITLLTNNSFLDEIGXQYVVTAPPQRPDTNAACSTGPYSRNAVLLGDCR

SEQ ID NO: 30821 - protein, 363 aa, Pseudomonas aeruginosa
  UNSURE (34): Identity of amino acid at the above locations are unknown.
PAITQQHGVAGIRAGRARGVSVRPLGRGGDHVLXADLVEEAVVGQQRDGGEVADHQGGYRQGQVPEIVEHIAAEAELVEVPRGQAAQGEPVPVAAAGEQHHQQDGEEEGGNGVADDDRRAGPDVEDAAMADRLGDPQRDRHQVHDQRAPEPERDRHRQFLDDQVGDLGVAEEALPEVQVQVVLQHDHEALGGRLVEAVHALDLFHQLRVQALRAAVLRAGHGDFAAAAGDAPGGAAGSGVEAFQQGDHLLHRTAGSGLDDDEVDQQDAEQGRDDQQQAPQDIGEHAALLPFRLGVLRGFGLRLARQRLVAGLPPGHQAPVVEWRHLRPAETVPVGDPPGIDVVVRNHVVAPRQYAVEGCLPAA

SEQ ID NO: 30822 - protein, 254 aa, Pseudomonas aeruginosa
  UNSURE (28),(29),(49),(54),(55),(61),(110),(117),(146): Identity of amino acid at the above locations are unknown.
TGSGGAFSSQEVGRQPGGHPRPLWPTFXXVGNQPQRQVEGQHGVAFGRXYILPXXGEFLEXYPDIVPDWHFDNRQVDLIGEGFDAAIGGGFELPPGVVARNLTPGHLILXASPAYLXDKPPIRHPGDLGGFDGIRIRSPQTGRVRXWPLRRRNGEEAPIELRERMTMSDPEATCEVAAMGLGITLVCMQHAYAYLESGALVRVLRDWYVDAGNTSLYYAANKLLPAKTRVFVDFVVDYFRRQDLARRFSAFPTG

SEQ ID NO: 30823 - protein, 415 aa, Pseudomonas aeruginosa
TLFCSLSFSSDLEDFQFAQRLADGGDRLPHLRGVDVADAADAEGFHLGQLARIEDEALLPHALVEVGEAVARIARRVEGNDDRRLDFRRQEAAETEPGHLAEQRFAIARVAPLARRQAALLFVLAERFVQGGDHMGRRGEAPLPGLAHIGVLVLQVHGQGVAVAGAGFQGGAAGEDEAHPGDALQALAGGGDQGIERNFPGIDPDRPEGAHGIDDQALAVTLDDLGDGLERIEDTGAGLAVDQRHMADRRIGGQQTLDVSGGGRHVLFGLEGAEGPLQNLADLRQALAVGTVDQHQDLAVARHQGADRRFHGEGAAALQRYAGVAAFAAYDLQQALADAGGEFVEIAVPGAPVDHHRPTGTVGGGQRTGGQQDGCAFGSAHAHFLCGNRPKKPDRASRSGRSFRAGVPGKPGDIR

SEQ ID NO: 30824 - protein, 128 aa, Pseudomonas aeruginosa
IRASAPLLPRQHPWCERNEGVPLEELDQQIMVLREPGSITRRTFDRACAEQGVQPRVLLELDSREAVTEAVAAELGVGVVSSLEVGNDPRVRAVPLVGPELTNRHLIGCLEKRRGLRVIRAFLELAAA

SEQ ID NO: 30825 - protein, 125 aa, Pseudomonas aeruginosa
RRSAAGVRAASATSSRSSARTPASGRVRRWRRRPRRSDSLVHSCGVRGDSGDGGLMIAAFACRRAYPPMAGAAPPVLFRFPGLAHGRIDEDSRCPIRSPPSPAATPEATPTPGWRSATPRRCSTT

SEQ ID NO: 30826 - protein, 140 aa, Pseudomonas aeruginosa
RPRTPTWIANWPTRPGCARPCSRRSGDASARPTCRCPIRGVRGCTTSAPPPATNTRATTAARVRRTAAWRSTKAPSNCCSIPTSWPTAASSPSAPSASAPTRACWPTAWTPAATRSTACSSRTSPAARCRPCPSTTATAA

SEQ ID NO: 30827 - protein, 222 aa, Pseudomonas aeruginosa
RTWRWNTPSCSRSSAWYDHRGGRRRRPSATKKGTFVKRRFWPAMGLLAAIMLAVYLANPFGTASLDPRARLLGVALYNIPSRSMEPTLQQGDFILANAARYAFADPQVGDLVVFRFPPQRSIAYVKRIAGIPGDRVRIDGGRLYVNERPVTEPYLAQQALRQPDSLRMAQRTVPAGHYFMLGDNRDNSNDSRYWGYVPRADLVGRVFAVWYAEDTRRIGSVR

SEQ ID NO: 30828 - protein, 393 aa, Pseudomonas aeruginosa
RPSEELGDADLGVASLAVDQVAAQRLAIGAVEQVVHGEVDAGVLQAQLGRDPLGEQPMSVVAVVGRVIPVDIAGTGTHPAAVAIAGQAVGLAHELALPAELGIPFRNLQAEHGHPLRRRDVARPHVRSPGIAVGPIVLAGHPRVGQAAEQPLAVVEALDLEALDGQARQVAVVAQRQHVAAATADTAVVDRLLAAADAAGAEYLVLDAVLEQRGADLQAVAGDQQVRQVDHAAATDRMDALGVQVAAAATDGRTVLHFVLLVDHRRSPGLGVVGEERQVRRRGPEHRQPRRPAGVGLGAIVMAELGIVVDRRQVGLAVVAHAVEAHRWGDGQAAVGDRVLDVEALRVLLAGRHECRLQPAVVVARGLVGLARHVHEDVALVLVQRRAQGQLVL

SEQ ID NO: 30829 - protein, 466 aa, Pseudomonas aeruginosa
RSGIETAGVAQLQDLVLVLGTHPFATGGELVEGGVLATVELLGAGVGIAQLQVDPGVVQRMVVVLAGPGGVGGIAVGQQAGQAQLVAVAVDGPLARRGRVAAGGERRPARAFRAQVGETQVVLLGGVQVELEQAGLLVLGAVGQALGVDRVVGGRQRQVVGQLHVAAVATVEIEQGIDAAVFAATEHGAGVDLLLVVGVIAVLEHGADVAAFAQQVRRVLGLHVHGAAEAAIAGEHRVRSLLHLDALDHFRFDEHGALLVALEAALLRAVQGIGHVLGVAQAPDVGGLSARLGRAAHGHSGQGLQQAGDVVRLLAFDIPPGQGRTADVAGVHFATVADDGLRVQLQRVVAVGIDLAPAHHVAVARLHQLQLGTDQQPLQRLAHPVAAAQRRSAQAPQERLVEQHLDLRLLRQARQRGGQRLRRQVEASFGSAGAGGPQRGAEHGGGTQRAPGGAGERQGHAGTLPK

SEQ ID NO: 30830 - protein, 164 aa, Pseudomonas aeruginosa
SPAPSRPSTGRHMATSGRNAARSPPVPGLRDAAPRSPARRRGVRGCAPPALRSSGRSPHRGSPRSVAAPPRIRCPLPAPAPAPGSARRCGAPAPGASSSHGWYGPPLSPQGNILGYSIFSTSRQDSSKCPAPRLPSPCAIPIGSTRATRWPSATRAGRYCSPPA

SEQ ID NO: 30831 - protein, 232 aa, Pseudomonas aeruginosa
KLPNCPAPPIHLARGRHGYFRQRSLPARDTPDPGLPVLPQPRRRSAAAGRCGLPVGAGERPRRPPWPRPVPDRQRTPPAALGPVPGAGPGARQPGPRPGQPACLPRRAAPGTDGEPALQHGHRLVAGGSRATATARPARPPRPGSRVAPGIPAARSPARVHRRLATLHRQPQPGRLTANGKIPRPKQTNRSENFLHTDTNGCATFASLAPEPTALFRTLRNFGTLAPVWESW

SEQ ID NO: 30832 - protein, 305 aa, Pseudomonas aeruginosa
PPRSPIVSDHTRQRRSRAMPGFFMPGRPSGLAGDGLLDGGLELRIVRGGLAGELRDHPALAIHHVLVEIPARRLAALLGQLAEQRDRLVAANVLRLGHGEGHAVVAIADLRGLGGIRGFLLEVVGRYPEHFQALPLVTLVERLEPLELRGEATVAGSVDHHQRLAGVTLAKIDVFLGTQLGQLALQQFRAIGGPAAQRQPGERQDGQQHARFHGMAPWRRMSQLTLPRAYRHLSACAHAQFQQRQSATLPAPPGESQQRPGGEQPGQLHAAPPATCRRATGRSRTGQLSSAASRLSRIDNCQTRS

SEQ ID NO: 30833 - protein, 1197 aa, Pseudomonas aeruginosa
  UNSURE (1028): Identity of amino acid at the above locations are unknown.
RAAHAADPESHRRRRPGAGLPGHPVRRPDDPGHPQQRRRRIRTLGRQARLPHADPQGLPDRTRPGKRQPRHAGVRRPRLYPRTRHGADRPRRADRHPLRRHHRHPGPRPARPQGPADDPGQGRARLHQGRGPVRRRPAEERAAHARPRPGAAQALRPMEPADPAHCPHRAQATRSGEHRQPRLPDVLRLRHAGLFLGPTGSRCAPATAPGRQRVGGLLQGQDRHQRVLLRPPASARQGPRGGNGEADGFDHGPEERALRLRLRRPPAARASGASVSAGASRGQQQRTNVVEHRVPLLLANVHQAEVAQHESALHRQERQARTAPLRCGQVQAFQPAAIPLVAALQMLGRLDQRRHQRRRLAAGQLVRTLGRLGMCANPRQWRRLLPCHRFEQAVVGLAPALEDRVDQRILGTEAVLHAALGNAHFLRHRIDGQAGRAFAADHRLGGIEQLVTVDRSSASHGYLLSLNPYVCIYIFTRPPVARNSRYPRRAMNRSPQRLSHVPAEPLAGPGHRLQRPVPHHHRHDRALHGPAAPDPRPRRDGRGETLDRQRLSAGGRRPAARRRLAQRPPWPQAAVPRRPAAVRPGLAVRRLRPQRRGADRRPRRVGGGRGTDDAGDPVDRPPCLPGRTRTRPGHRHLGLRRLCRRGAGAGGRRRAAGVLLVGLGVPHQRPGGGRRFVAGAAGHPGLRRPVAAPMGRPRLTAGDVRPGRGGVCDQGTQHTRPGLRAGRPRRARRHALPVPVRPPPAPRPRTDDRLRAVPQPALRPRRRGGPGGDHGAGRHGTGVQPAPATGAGPDAAEGRPVRPADPAGLAGGRAAGRLAGAALGREPGDVRLPAARQRRIARPGPVLPVRHRSATGQPGAARRRLRRRDDRRLHRGDAQRGRTEFRNGGRHRRRVLRIGRGDRRDPARQPDEFRLRDVAEAALGRAAGAGPRQPRRRPVGRRGPGAGGRVAARRACPAGFRPGLRRRATGRRRAALPQRHGGPAPAASGYRASATSTAHSVSSTSAPAVSPVVPPRRARKRLRSQAKXISVTSNASRPARPNARARPKLTPSTHGRLRAGRCSAMAWPRPPGRAYGVVRNSSGRLLRASHGASGNNPASPWPSSAAREENFNNRTSTRTTTATGPLRGSFMIARVRSRSPSPPTQASAMSARPSRCSAPLSATHRLSSKAACNSCGVPSSDRAAAYSTTPISTPTSG

SEQ ID NO: 30834 - protein, 432 aa, Pseudomonas aeruginosa
PAGPSVRLPPPCASAPSHARSRRRRGCRGNRRRTRFRHAAGGPGAGSCRAVRDRRFGEGRHPRVQRAGLAQQRHRQRRAATLAQAQAEVEQRLRRQGFEHMAMARLGTAVGEQQPVAAGRVQAHRAERRDAADVAVDQGDHAFLRAGQVGAGQRGDLQATETAEGFEGVGAMGAVQGQGTLDHRGLVRHAAGVQPGSRPDQRARRRIQQRAGHGRRRGGIADAHLAADEQLAAGLLGAAHAFAPGLERQQALFGAHRRGLDEVRGARRQAQVTHAGQGFQGERGAQVDHLQAGAEFARQHADRRAAADEVAQHLAGDRLRIGRDALGDYPVVAGEDRHPDPLQARSFAPLQRRQVDRHLLQAAQRAARLGQPVLAFGRAPAHLRVRLAAGVAPPLQTHSGSPFNGMGRPATVKVTRSQRSAMAWCSQPASST

SEQ ID NO: 30835 - protein, 521 aa, Pseudomonas aeruginosa
LTASPLSAARRSARRLLPERAPPRIRSRMGFSAEGEQSPGIQVALDQVGEPLDVAFAQGLVVHRLDLAQAGPAQQRRTGRGGFEQAVQVGAHDVPVDATGTIRATIVEHHRRPRQGLATGDPGMDLVARQRRILQAQAALYVAQLLVRLKGRFQRQQAEASAAAGRAFQAERIVQALAEHLQAAADPQQATAVAQVTEDRLVPAALAQRREVGAHALRAGQDDQVRRRQRLAGADEAQLDLGVQAQRIEIGVVADPRQHRHHHLQARPDLGRLARVDGVLRLQVQVADIGQHAEHRLAGACLQPVEAGLQQGDVAAEAIDDEALDPLPLRVGEQFQGADQVGEDPAAVDIGDQDHRTVHRFGEAHVGDVVGAQVDLRRRAGALHHHHPVGGGEPPMGSQHRFHRHALVVVVGGGVHAGHRAAMDDHLGADVGVRLEQHRVHVGVRRQPAGLGLDRLGAADLAAVGGDRAVQRHVLRLERHHRDAAPGQPAAQRGHQGALAGVRGGALDHQGPPAITHEQAP

SEQ ID NO: 30836 - protein, 157 aa, Pseudomonas aeruginosa
PPAARRGCRDRARPRPRRSPAPGARPGARRGRARHSTATGRRPARPAATLAGPGSPPGCRPAAIPVRRRSRGRQRLPGRRRSPAGGSRPARGSPAAETARARCRWTGPASPPAECRSGAPPRATALRVQACSHPMAQSPASTSSQNSTPWRTSARAR

SEQ ID NO: 30837 - protein, 200 aa, Pseudomonas aeruginosa
GSSASAQASRVSGSTARTQAVTPWLRQPTPGSASPARRERLKRRSRRSARRPKATSGCQPCGSPKRASSATPRIPSSALMLARPNGSGRPARPADAVRSNPPAPASAPGRTPPPGPGRAPPPLRCRAAGRAARPARPDRTAIPSPSPGPRRDWPARGCGSRRRATPGPSAAGSGDRTHGARGRPSERRPAVRRNPARPLP

SEQ ID NO: 30838 - protein, 980 aa, Pseudomonas aeruginosa
TGAPEARARIIGSRKSGPHLNTRTRRPWRACRRARAAVTVVLPWPEAGAAISRAGQRAWVMGEASPRMAPASEFHSFLRLDPGLERVLDQTHLGHRVGGLDHPRLRAAAGHHHMLHGRARLDVGEDPVQFQVAVLEGDVQFVQHHQAHVRVGQQLRGDLPGCLGLGDVALAVLGLPGEALAHHVVADFLGEAPEEGFLAGAGGALDELHNADLHAMAQGPRDHAEGRAALALAVAAMHQEHAAFVAGLGDLLVNHGLLALHPLAVALVLLRGFVHRRSLLAATRPRRRLVHSKYPASQGLVAHAEVDRLARLVVAIRGFVVGTEQVGDPALQAPFVVQPVLAAQVEGGVAAQAHLVGRIIIASAFGVHAGAQRKTLEAPVQFQVEHPPRPARQLVAVVDAAGTVLRVEEGRVGVPVPTQPLAAEDQFDAADARFVDVVRLPPGAPRSRTRIVADQVVDVGTEGIHRPVPPAMRTAQPDLQAARSLGVQVGIAVVGVVEFVEGRRLECRAVVDGEAQRVAQRVAPGGAAGVVHAELLVVVTAQAQLPILATVLAEVLGEPAFVQPRVDAEGFAAADLVLLPVVAEGQYMAFGQGQVVLPGQAVATGIEARVETAILIGIGLVLAAPGLEGHQPGIERSEAGTAADQVLLAVGVGIETGVAENLVIVVVRLGPEQRAVEFQAIVEAIAAAQVAGQVAVAVSVWLIARSTGALGIDPRRIEAAHPEAVPAVAGAAADPGAALQGLMGAVTGGEERLGALAVAAPGEDLDHPADGLRAVQAGTRPADHLDALDQLHRQVLERGEASAGRADLDAVDQHQHMVGLGAAQEQRGVLAETAVVRQRHAGYLAQQLRHAARLAALDILAVDDAHRRQALGSGLGGTGGGHHLVGKADRFGQAQGRSAAQRYGCRGQENSVHALRCSVALTRATWVKADGGRSDGRRRPTAPSAMPWVRQAGLRARERSAGRFQPRLPMPEHSGHRAAV

SEQ ID NO: 30839 - protein, 239 aa, Pseudomonas aeruginosa
TSASTLRPAALASPSRRSRQTRHRCNCPCAASSARRKRCRQASNSAWRPSRNSASSSSSQGCKACALAGSSSLRSRATLRAARSRPSRSRPSTRKAWERARPSAPSNQAWSRWASAAEIRPSAASSSPRSSAPRSSAAAACKPASRAALPWFANWRSRRRGQSSTLTSAAQRMPRPISEQRATAWSNTVAGSALAGRATIAAVYPARTKPYDAWLCINDAPAVQNASQSAIRRRKGSDA

SEQ ID NO: 30840 - protein, 261 aa, Pseudomonas aeruginosa
SRPTRLRRRRQPAAAAAERSYTISRTFPTPRRLPRLPLSMLNAPNLGIAPSASEIIAKHLREAIIAGHFAEDEPIRQDDIAQLFNVSKIPVREALKRLEAEGLVLFQRNKGAVVTRISEPELAQMFEVRVLLEAQAIRLAVPNMDETTFARAEAICADFVGEDNVGRWAELNWQLHACLYEPAQRPFLVNLIRSIHDKLERYLRMQMSLSEGKQRADQEHREIVAACRAGDAERAAALIEAHIVGVCRTLYEHVPNRPAST

SEQ ID NO: 30841 - protein, 161 aa, Pseudomonas aeruginosa
GGSVPACTASRHRSARSRRPSTRTARSACATCRPTATVARSASKCPASAGSAATSPGAATGSSWSPDTASASPATTSTPSPPTPSPSSRRWKTRASAARTAAPSITSNCSPTIPTPTAATSCSVPARPTTARPAAPAPAPSWPAWPPTASCCPASPGARRA

SEQ ID NO: 30842 - protein, 328 aa, Pseudomonas aeruginosa
LGTGLAARPRRRPEGAGRRHPLRAQRGALAARTSRPAPASIARRSQRSGRQPPAPGRRPLAERRGAGAGQRHPCRRAVRGAADPPEERPPADHRPLSRHPPPSTGGTRLCQQRPRQQRYLGSLQRPAAPHRAGLPRLLAAVRHARPAGGRPGAGAHAAACPGLPAGARRPQCDPCLDRLPRCHSGRPAAAWRAPGAAGPVAGGRPRGPGRDHRAGQRAPARRPVVRRNAAAGCHALSAATLPLQLRECPAMIELFIDRRPLRVAVGTSVAAALALGGDGCSRSAVGGGRRAPFCGMGACQECRVLIDGRRRLACQTVCQSGMRVETQA

SEQ ID NO: 30843 - protein, 663 aa, Pseudomonas aeruginosa
SSVPAPPAWPQRWPPRRAARASPWSTTTRPPADRSGATARVPACRRVPIRCANAWPGRPMSSTSRRPGWSPAVPAGACCWKTRNVAGRSATDAWSSAPAPANCCCLFPAGPSPASPAPAACRRWPRAACHWPASAWWWLAPARCCWPAPPAPASAGRACCASPNRRRREPWPPSPYASRAGPASCGRPPACSPVATAPTATCSPPSARSAWKPCACAKAVGSARSPANAWPAASAWCPTCNSARPSAIASTARRSPSTNGRPAACPTTTPPANAPASAAANWPWWKAPSPAMPPSTSATRLAACGHDGDAGRASQTPWRDTSPCVPNCVNWRRRIPWSAVAKTSPWPRWPGMPAGPRPSCTAVAAWAPARGGYAAAPRNSCSAGRLRRRVRRSARRAWRPWPAGRATPASDARRDSASRGRPATAADHPAAWVSAARRTSSAPIAGSAPGSGTAPRCHPVRKDGAGPASTGRSRRRWAAAPARRARTGIRRTAAAACYPPPAPGRRTPAARRRSARTAPRPAIPAHRPSASATGWPGPALACPAAAGRRPSPAPAPAPAPHARPRAPRRRPGRSPATAPAAFAAPAGPTPARPPAAATGRPSAPPRPARRRVRWPWRSARCSPRRPTPRSAPGAATGAPTTGAARPRRRAAAAPGKRRSARSW

SEQ ID NO: 30844 - protein, 374 aa, Pseudomonas aeruginosa
GTPAPVPWHSGSRRSRNSRPVPCPVARPAGGSPRASLAGCRWSRASLASVGQVRVEARRPPPLLSNETICTSHAGNRNHERQPGYRAAAYLPCHPALRPLSRRGQPPQPQPLGGEHPRPAPGGTGRRPAVRARQPVGAADPAGAAVPAPDRRAAGDPRPRARRVAQTGRAAARALRHFRGIRRQAARPPPATPRRGTAGAGAGGAHRRQRQAGRTPAARPAGPRPAGASARRNPVRRALPRDRRHPAGVGRRPRPADRSATPAAAGPARPGLSLSTGAAGSPRRDGPALAHGGQQSRRGGAGSGHRRRPGDRRDRPCAGRPDDARAGAGGGLRRTARPPHSPGLRPGRAAAGAGAPRRTDRRGVPALSRYSAGR

SEQ ID NO: 30845 - protein, 388 aa, Pseudomonas aeruginosa
TRRRWPSVSFRQQSLTARRCFPVHATRAATPGAGAALDVRALLSQDGDIAVEGAQADPQFAGEHMPSHRVTVPAQNLQQVEQALATGQGADSQLLQAVAGVVVEGDEDQQAIAVLRRRPPVGLLQFEFAAARMTEALELVFDTHHLVAPPDLAELRRSLQAALQLPLPQRIAHALDHCRAEEADHPRQRLLAVGHAVAPALVGQRQVDAVAVFLGDLRQVDAHQPAIGAVVAADVETGVLHHGRQRVEGIEDGLGGGRGLLADRPPRRGRRGQPGEVEQVVGFRLVAQQGPGDGSDHLLRSAYRAALLQPGVPGHADPGELRHLLATQARRASAAEAGNADPLRLDAFPPAAQEGPQLFGAGRLRGAFRSVAGRGVEGHGEVLRRADG

SEQ ID NO: 30846 - protein, 428 aa, Pseudomonas aeruginosa
SSPSTAWPSRVCLAMGGRLGDNYGRRRLFDLGVALFAVALLLCGLAGSVWLLLVARAIQGVGAALVVPQILATLHVSLSGHAHSRALAAYGAIGGLAFVVGQVLGGFLVSADIGGLGWRSVFLINLPICLGILLCSRRWVPETRAEHAARIDAPGTLLLAALILCLLLPLALGPSLHWSWPCALLLAAAVPLLAWLWRTELRQERRQAWPLLPPSLLRLPSIRFGLLLAILFFACWSGFLFALALALQAGAGLSPVQAGNAFIALGASYFVSALLTARVAARLGPVRLLLLGCVIQMCGLLGLMLTLQRVWPQPGILNLAPATLVIGFGQAFIVSSFFRIGLSEVPAAQAGAGSAMLATVQQASLGLGSALLGAVFAHRLERHGDYLEATQTTLAVEFVLMTLLLGATCLFYLRRVRTVPLRCDSPGN

SEQ ID NO: 30847 - protein, 195 aa, Pseudomonas aeruginosa
SRRPIPDRIPALVSGRADVIVASTSDTLERAKTIGMSIPYFAFVKVVLTREDTGIASYEDLKGRPVGGTAGTFEALALEKDSRAWGDAKGSFRAYHSEADTALAISQGHIDATVVSSTVAASWIKSGKYKGLKIAGDAPYDIDYVALGAKRNEYGLLNYLNLFINQQVRTGRYAELAQKWVGGTAPELTTSAVYR

SEQ ID NO: 30848 - protein, 432 aa, Pseudomonas aeruginosa
SRGRGPPPGRAVSPRPGCADEARTPHRSPYPGRRQRVRRTAVRTDRPELLGRRRPAQRGSDRPSPPAQRPPSTRQAAGDSRWARLLYRQQRTAGTDPRRTCAGGDPPARTGRNPRPRRDRRRGTVRPLATHRLSRRALRRTRRLSLGAPGRRTPGTPPRCPAAAGDPTRRSAGDRCRPTTGRLRPGPARRRTRRSRTPGDAHRPAHGGVAGRATADRHPARAHRRLHLHRPGRPALRRNPARPRCPGTGTDHPQHHLRGPAPLARTGRTRRPRRASRGPGPGLSRHGRAAQLHLRALPARQQRAGRRTDRLGRVQRGALRQQRARRTHQQVRRLHGYLLRPHRSRAAGRLPPRRAAPGAGTDRSGRPRQRRRCLLPDPRLPLRPALRRADPGDRRPAAAAAGPRRAQGLRRGAGHQFLGADVPRHRRHPGSP

SEQ ID NO: 30849 - protein, 388 aa, Pseudomonas aeruginosa
PGQRLRRPRAAADPAGRTRAPARRLARAGQRRRDADRPGGAGQPALLRQRIRPARRALPRPPQTPGGSAGDHQQPAGRRPGRSGRAPGDAAGVRRAAGHRHLLVHARRTAGAAGRAHPDDQLRQVCPLRPRTGRPPGALRRPRRLRRGRRRRAGPRRAARLVERGLLMFDYTFHWRSAFNALPEMLAGSLVTLQVTALSMLFGILIALLLAFARLGGNRPLRAAAGAWISIARNTPALFQIYILYFGLGSFGLHVSSWFALLAGVTFNNAGYLAETFRGGLQAVPETQLRAARSLGMSAPQAYRLVVIPQLLRVVFYPLTNQLVWAMLMTSLGVVVGLTDDLTGVTQALNVKTFRTFEYFALAAVLYFAMAKLLVLAARLLGWRLFRY

SEQ ID NO: 30850 - protein, 457 aa, Pseudomonas aeruginosa
GECRVHHQPHRQRPAVPPARRLDHPRHHRHGDADRHPAGCRLRPAPRPAATRQPAAGGAARRIPQRAAADPVRPAQFLQEHPRPRLERLRRGLPGARRVRRRLLRRGGPRRRPLGTAERAPGRAFAGPELSPGPVPHRPADGRPGGLPRLGQPDPVGDEGHLAGALDRHRRTAARLADHRHAHPGTTLRALHRGARLLPHELGGRATRRPAGTEMAAMIEISGVHKAYGQFEVVKGVDLRVDKGEVLSIIGGSGSGKSTLLMCINGLEPIQRGSIRVDGIDVHARGTDLNRLRRKIGIVFQQWNAFPHLTVLENVMLAPRKVLGKSRAEAEAMALKQLTHVGLGDKLKVFPQRLSGGQQQRMAIARALAMSPEYMLFDEATSALDPQLVGEVVDTMRMLAEEGMTMVLVTHEIRFARDVSDRVAFFRNGLVHEIGTPDQVIGNPQRPETVEFLRSVL

SEQ ID NO: 30851 - protein, 1266 aa, Pseudomonas aeruginosa
ARPRTGDSHAFAADRPHRQLPCRRRGRRRDRRRRRRAARRHPLGTVALDRQRPGPAQLRPQRTARRSVPPRQSAGAGQGPARADGLDHHGAGRHPADVRFQFAVRGHRTARQRHPADARTADPAAAGSAGRADRGPRGMPRRQGRAGGNPQRAVVRRPPRRLDRSRGPRLATGRHRLRRRQLRHRRRPAPGLRPARRRGRRAGRHRLEDHPRGQRTTGLPPPDQPGLGPSILLPAGRAAGAPRRCPRREQRGGHPPRQDRPLALRHRLLGADGGAPGERPAAGRRTLRRALHHRFGIPLPHRVADRTRRPFGDPPVPVRAGLDHRHPPVPARPGRSLAARLSAVRHLARRPLLTTPPDRRQRPGGNRSGAYRIAHDGERCRRPVTRTAAVRLNSYTKYEKRRNHEQARQLERRIPRGHHPIQRRFLGEPGGNPHGHLQPGARRRVRAGGMRQRRREHLADHRGEDGRHGGRQGCLRRPRAGDLRDRRVHQRRRGEGGQGGGAGRRRRHHGDAGAGLFLQAARDRRAFPQRGQRHRPAGDGLQQPADLPERRHPGHPGFPGRLREHRLLQGQLRRHPPLHRRTQPGGRALHPLRRARRRGPGKRGGGCPGLDLGNVQRVPEGRRDHLPPGQGRALRRGDADLRVADADPPSRRPSRPGAVHQALRATRRSRQRPHPSTAPGPARRRSRARRADHGQGPGQPAGAAGHRLVADAPPSPPRSPGSGRRGPAAEHSVHRPQGGPMPSILGHNYVGGARSAAGNLILRSLDADSGEALPYAFVQATEAEVDAAARAAERAYPHYRQLSATRRAGFLEAIASRLDALGDDFVALVRRETALPAARIQGERTRTANQLRLFAEVLRRGDFHGARIDRGQPGRTPPRPDLRQWRIGLGPVAVFGASNFPLAFSTAGGDSAAALAAGCPVVVKAHGGHMATAECVADAILQAAADSGMPAGVFNMVYGSGVGEALVRHPAIRAVGFTGSLKGGRALCDLAAARPQPIPVFAEMSSINPLVVLPEALRRRGRQVAEELAASVTLGCGQFCTKPGLVLGLRSPGFDAFVAALGEALAARPAQSMLNAGTLRSYVEGLQRLERHPGIRRLAGAPQEGRQAHPQLFKADVGLLLEGDELLQEEVFGPATVVVEAADEEQLARALDNLHGQLSATLIGEADDLAAFAGLVPLLERKAGRLLFNGYPTGVEVCDAMVHGGPYPATSDARGTSVGTLAIERFLRPLCYQDYPDSLLPDALKNANPLGLLRLVDGRSTREALD

SEQ ID NO: 30852 - protein, 392 aa, Pseudomonas aeruginosa
  UNSURE (51),(52),(53),(54): Identity of amino acid at the above locations are unknown.
PHLGCRRCDQRRCRLSRRRGPARPESSALPRSAPAPRVWHADHPWRRYSPXXXXRPRHRRGSVTLRHLAARQACIDVADHRRQLGDGLDQVVRTRTFEHLFDTRPLALQFGRRQRLVLLVGEAQGIARAGQRHRPHPGAAPFEDTRPGVVDLHAGRHIVDPQGDHVGQRLGRPWPAVGHFVGGHHVVGDVTVGLGQGYHLLHHHRRITGTGTDLQAHPAEFGDRLQGAGDQRRMFGDLFDLQRHEALVDGGDIVVAGQAAEDGAVALGDRRDVAEGADVVPLAHSHRTARFLQADLDAEFGESLDEDLGRREGAEIDHGSRPVEDGGLEGGWLVVIHCREPFSARCRSVQISRTSSSRSASPMAATACRISAASTWPMQPTRKVSTWVNLPG

SEQ ID NO: 30853 - protein, 419 aa, Pseudomonas aeruginosa
RTGRPGRVARDPVRGDQGTHPRDRPVVAQSVGSVAVLPAHHRRRRIPAPLPLPASGGRQPGGRRRRRATVARSQPVGRRRLPLPRRLQHQPRPEPAGLQPGHQRRRDLPPVRQGPRQRRGAGPALRRLRRQPDLGQRQPHAVLRRTGRHPPPAQALSPPPGRGRRRAGVRGRRRALLPALLPLQLGTPADPPAQQQDHQRGLGARRRPAAGNVPLPGAARGRPRVLPRPRSPRRPGPVADPQQPGGDQLRPLPGRGVAADSRALATARGPRPAADPGRCQPERRGGDPRPARRRPAGDRGATAGPAGLPRAVAGRRLQPLRAGQPGIRQPLRATALRGPESSGAGTPAEPRRWHADRPQADPGGRPLRRRRLRQPAHLGQQRRRHAGAGQPGGAQGSPRRHRRRAPRAALSLWLRRLRA

SEQ ID NO: 30854 - protein, 131 aa, Pseudomonas aeruginosa
PRRTPRLSSTARRGCARRNAPAPGYRRRGTASIRPPGPPRAARQVPCRRRGSVRATGRARTGWRRAARRTRRTPPPAPGAGARPAPAREYRPAPGAAGRRIRARAAPCPRALRDGADRRVANPPARPGRQR

SEQ ID NO: 30855 - protein, 434 aa, Pseudomonas aeruginosa
SSPPPPPGQAPAGTWLLQVGTQRGHHQFQVFATLLRARLLGAEVFADVPLQHFVHQAVHRTADRRDLLQHRRAFAALFQRLLQRPGLPGDAAHPRQELLLPMDGMGHRSLLKVIYWGIVYFRRLDRTVANARHPDYPAPAPFPSVRPGQPAGRAQHALGGIAHRLHDGRGNRRRLAVQLHGPARRRLAHELPCPGPGSCGTRLRRRAALCQRPALQLRYVEDRGARQLHQRPAASAGGRADALPIGRTPARPQPDPLPAGDAGRRARPAGQSRLRLAAARRHAHHGHGHSHHHHHHHHHDHHAAPARSESCAPPNCTCWRMPPTLAAGRSSRWPAACLLNAALAGPADGYRRGGTGQCLGMRPDPAEQPGIAGCADGRAGGCGNPRGDRQQPAAGGTARPAPVAGRPGQVRLPAESADHRGRQRRLFQAPPGRA

SEQ ID NO: 30856 - protein, 497 aa, Pseudomonas aeruginosa
GTGAHHRRGEPAAPARRLRERGSVAASEVHLAAHGGTRPEAREVVAEQFDHRPRQGRRGGVPGQQEARGMPEQVVGRQRLFAADVDHRAGQLVVLQCRHQVGVHHRDTTPGIDKQRRGLEPGEQRTVVDVVGIGGVGQQVDQVVGRLHQATEVVERPHAVERHQRTRILRHPGQVHAEAGQGMRHRLADLPGAHDHHLPATQPARRAAIPLRTDLAGQATEELALVGEHIGQQVFAHHLAEDAYRACQAVVLRQVGGQQRRDARPGRLHPDRMHALAQHLRHQVGLAEPDRALAGGVDELQGIVPRHHLQAGVGRHQQRGIESVVTFENQQAHGSHCQAGQGLAIRPENIVLSCITAPGGKPSRAAGLALVDHGRCQGFRYRATSCGHHAPKAQPCTERVSRRESGAGKPAPAGYGSRQSGSFMRSNSSGRCSMYSSSPGGICKWKPCFSMFSRTLATSSRASWRSGVSSRSKTCCGAPNGTSRASGTRLNASRLST

SEQ ID NO: 30857 - protein, 492 aa, Pseudomonas aeruginosa
KVSTRMNSVSSARYGCVRHSRHCCARLASSRIHWISGAVTNISLVKCGALYRAWRHASIPLGTALADERSECPYSALCPTIRTRELHEEAQRNNRPPAGWRGSLPGPEDQPDRPARLGCSGRSADDRGPRTQRHPDEGRAAWPGPVARPRGHRRGQPGPRLCRSRRRPRGTPGRQRQGRDLRRHRRPPAGHGLRCRRQPDPRRRLERPAAHRSAGQGGNPRHRGRRCPLRLHRRPRHRQRRPHLLQRRFQQVPPARLHPRPARGPTARPPAALRPVHRQDRGAAQGPVLRQWRGTLGKRGLRTGQRDLPLSHHPLLAERREGWPARGVHRQPAGLAGQPPGRPQGYLLGGPADPAQGRRRLPPPASLAEGAAGQAAAHVPAQADRLRAGHRHRRTGQDRPQPARHQRPPPAHDHLGEAGGRPALLRQPGKRSDRPSGDSLKKPRRKKARRKRRAKPIGQASRGIEHRSGYLGTSRFCMSGQIPRCRARLMTE

SEQ ID NO: 30858 - protein, 136 aa, Pseudomonas aeruginosa
ESSSPGASPFLSPFLRLAARRRDDATRSKGHDPPIRHRLCFPTQGVRDVVRPTADRATTGSPPQRTRPAGPRLPFRPRRPVLRCPRLSGEPHSRRAFRRPRTGSFRSRAQGRDRSPSAAGSRRASAQATSLGPAPG

SEQ ID NO: 30859 - protein, 211 aa, Pseudomonas aeruginosa
PGGALRRRPRRIRRPRLVAVALAGQARWGLPPRWRPGGLEGCGAGTDQWRKQSSTRRFPGPARCLAVDRRRHPPGPTGPTRTGAARCSRAAALPWRSRAHRSGRRTHSRCPVRRLHRQPWQRRPLPSAGTIAPAVLRPVARSPGGRAGRLLRLRRHRLPQPVRPEPRRLPASAPLRRLVERVDHRPAPPGRHRRLTTPYARTRLTPRRAAS

SEQ ID NO: 30860 - protein, 185 aa, Pseudomonas aeruginosa
VRYRRGHRNRSCQTARPRRSTLREAVMGISANDLCQHVIRPTLDYLSCHSPAAEALLLGAAACQSALGSALDDRRGHGLYRIASERHQQLWDQYLALDPERASRVRGLASQHAFLAAPHLELTVNLRYSTAIAWSLVEAARLPLPDQHDHLAQARVWRQVFQPHGRLHEFIDAWQRCIGSLSQVA

SEQ ID NO: 30861 - protein, 164 aa, Pseudomonas aeruginosa
TPPGSRRRRSPAPAARTRNARRPRAALRRGSVHGPAAATGDPSSARPAARSAPPAGPGRAGPRTSPASRSGRGYRAAWRTGRRSRPRWRYPSPCCAAPPALRGRRRRGSPRTRCRKGPGRSAGRRSATAHWPTARVPSGPGRGRTAGPPPAPPAPRRSGRRAPR

SEQ ID NO: 30862 - protein, 201 aa, Pseudomonas aeruginosa
TAGPGPRPGSARRWRRRRLRGPSRSRRSSARGTGRSHVARRGTGRGSGLRTAGSRRRHAAWVAPSTGIYPLYRERSASARGFVGCQSSRSSSTSNAAKAPLRSSPRRPARRRCASSQAGVPRSRASSPAGVSSTRRLRWSSPPVRRSRPSPSSTRRLRPRVLRSSPMASASSEMLGRSRRRRCRSRENCATLRPVSASASS

SEQ ID NO: 30863 - protein, 626 aa, Pseudomonas aeruginosa
LALSAATGSTRRPPSIAEVAMPVYKAPLRDTRFLLNEVFDFPEHYRNLVNGAEATPDMVDAILGECAKLCEEVIAPLYHSGDEEGCHLENGEVRTPKGYKEAYEAYVAGGWQGLSHPVEYGGQGLPMSLGALKQEMMGTANWPFSMYPGLSLGAMNTLMQHGTEEQKQTYLVPLTEGRWGGTMCLTEPQCGTDLGQVKTRAEANPDGSYAISGTKIFISSGEHDLTENIVHIVLARLPDAPKGTRGISLFIVPKFLPGEGGALGPRNGVSCGALEKKMGIKASATCVMNFDGATGFLIGPPNKGLECMFTFMNSARIGTAIQGVATAELAYQGALAYARERRSMRALSGTKEPDQVADSLMHHGDVRRMLLTQKAIAEGGRALVYLATQYADRMIQGILSNDDAEYERWDDKLGFLTPILKGCLTELGLESANLGMQVFGGHGYIREHGMEQIVRDARIATLYEGTTGIQALDLLGRKVLLMTQGKAVRDFTRGVARFAVDLLKNEPRMRGRALVLLKLCAQWNLLTLRIALTARKQRDLVSTASHDYLMFSGYATLAYSWALQEAAARRRLRQGGSESADFYKAKIATSEFYFARLLPRAKGHAAAMAKPTGSIMDLKSEHFAFD

SEQ ID NO: 30864 - protein, 509 aa, Pseudomonas aeruginosa
TVRHRGYPMFRQNRWLVLAIVSSALFLIIIDMTVLYTALPRLTHDLGATAAEKLWIVNAYPLVVAGLLPGAGLLSDRLGHKRLFLAGLPLFGLASLCAAFAPSAAALIAARAGLAVGAALMMPATLSIVRHVFQDERERALAIGIWASVASAGAALGPVVGGVLLEFFWWGSVFLINVPVVVVALLLALPAIPACGGQSRRPWDALGSLQVMFGLVGVVYAIKELSTRAPDFGLVVLAALGGMLCLYLFVRRQRRAREPMIDFALFRNRRFARGVAVALVATMALVGMELVFSQHLQLVQDLTPLKAGLFVLPIPLASLVVGPLAGWLVPRWGENRVMCASLLLGSAGLLGLALSYQSVTGAQLASLVLLGVGFGGAMTAASTAVMLNVDEQSSGMAAAIEDVSYELGGVIGVTLLGSLMSFVYGMSLRLPSAELPARVRDSLDDALLVAEGLAPEVASRLVELARQAFDQAFVAVLLAAAALLFLSAMAVLRQPRPATEPAPPAPHTR

SEQ ID NO: 30865 - protein, 122 aa, Pseudomonas aeruginosa
APASAAISRPPRRRRVSKGSARWAPCRARARSITAALCATPLASSPVPGPTSALAGASSSAQAMAAAAVVLPMPISPPMNSWLPACSARRTLSRPASSASRHCSAPIAGASTKFAVPAARRR

SEQ ID NO: 30866 - protein, 149 aa, Pseudomonas aeruginosa
SVPAARRDIPAAPRARRRDAGDRRRAAGWSATGSGSRPAGSVRPRPRCAASPPAPEAPPGFASGPGGARGARRCAGPFRRRRPGRWRCSSPPARSRRPGARPGGSCRNGRRQGSGHAWGSPQRASNRPVSRWRSTRSASRSMSRSRKAW

SEQ ID NO: 30867 - protein, 541 aa, Pseudomonas aeruginosa
AAASMLVTARPWMITWAPMSVFGLSSTGFMSVCGASRQAWAWTAWARPISPPSAVTALFSAMFCGLNGTTATPRRASQRHSAVTRVLLPASEVVPWTIRVRPRSLMSRLLEAEQRGIQPGPGGLVGGQAEAQAGRLLELAGEDAAPRQVVVQRRAAWIDQALEQRAAARRRPAVAAQQFLQALAGGQQALALLALLLAVAQGILGHMAHRAIDRPRAELLGQRLQQRPFAEGEAEPRTGQAEELAERAQHDQSGSVDTGRQARLRGAVHERLVDQQPAAATLQAGMPGQQLGGLEDPPGGVVRVDHQQHVEAVEIGLDLGLADLPHQVPGLAPGVGVLGIARRQDADPPAPPQPWQGLDRRLAAGQRQYPFGAVVEAGSGFQAVVALRQAGPGLLGDRRQRKRPGRDAGGQVQPVRQRNVVAARRLAQPPSVFKHAATPWPRVRPAPAARTARPGVPAPGPDRCRGPAAAGRCRGAAAGAARRGRSPRRPGTRPAHRRRRPSPGRRWGCPIAAPALASSAGPGGCRRAARRSAPPAAPAGS

SEQ ID NO: 30868 - protein, 574 aa, Pseudomonas aeruginosa
NGAPGDRPGGRRRPAGASPAARRSAHPAPRRGYPAVRSCSLAPTVLVDQLGQRTRFAPTLQRQHRRRVELRHRAQAEHRHRFAAGRQAEQLAQRGRIEQRYPAHPQALGATGQPEVVDRAGERRQVHLRQGPATEHMALAVVHQSGDQQFGAIQHALYLEPHELVGALAEGFGGASAFLLDQPVDGPAQRRLGDTDEAPGLHQADAGRLVRGLQQPREQLRRHAAAAEVAHVAALGDGPVDGGAFRGAEGVGRIGHVSRRLARAPATRRRPAGWKAGRNGYRKPSAGQDGTPPPPCSGRSGRRHGPEARRRSRGSSDGRYARAAALPAARPPARPGRSGASAGAPGPAAGRAVRRARRRRLPGSRAGRACRRTRPAAACRRHGGLGSPRPWRDCPAGAPGAVRDSRPAGTGCPRRATPGPAAARRTPVRRRVRAAGRDWPGRGRRTRRRGPRRCARLPGYVAAAPERAPRRSPAPAGRSRRWPARRRRRRPGAHRDRPVPRPGPGPGGGSAIRIRPSAADRRTSAYRAAGNHAGCRCGAGCRRGCRALRKTAGPAGNAPVRRPARRRSGPSPRR

SEQ ID NO: 30869 - protein, 71 aa, Pseudomonas aeruginosa
RSRGLRQGRRDLLQALPQVEQLRRRSRVPSGRPTRAGGAPPANGRSAAPGGSGDPRCARRTRPRLAPASAG

SEQ ID NO: 30870 - protein, 326 aa, Pseudomonas aeruginosa
STPRPTRSARRWPARTRLRRGTPGRCAGRTARRARCPGARRWRPAPGGWARHRPAPRRCARPPSPRRAGVRGRPGTGATVRAPRPAPGASAAGRPRTRPGGPRATVPRVLPARAARRARWPDRAASAREPPCAPRAAGRAGRGLARARPGNGRGRAHPRTKRGRAGRPPRRSAPAPRAARRVRRRRAAPPRPPASRPPGPPCPGSPTGVPGAAARAAHSPAPRRGCPGRSPSSGPPPGRTPSPDRRWPAGRRSPRCIRPGRNRTTHGCASTTRRRCRTPARAPSEGGRAATPDHTARPCRWTPAHRRRCRSGGTCPWPGPCRYRAG

SEQ ID NO: 30871 - protein, 140 aa, Pseudomonas aeruginosa
FSIVQPLRELSGRAFRPAKHAPRRPTEADQHACAEGANRQRQPPSVRIQYPARSQRHAGCPACLSPCSTPLTWASLLRPPRSSPSTCAKRSSPGISPRTNRSARTTSRNSSMSARFPSARPSSAWKRKAWCCSSATRARW

SEQ ID NO: 30872 - protein, 652 aa, Pseudomonas aeruginosa
APAPARRAPRRLARRLHPRAARQRRTGRRPALRAGRSRSLCRSDLLQQQWLPRHVRPRHHRPGRLAGTPRADRSRRAPHRDTGRRGRGDPPRGRLGQRAQRAGLPLPSPGQRRSARHRPGQRRHRLGRQLVLPGRRTRPAHRRRQPRRPHRLHRRRPAGAGRPGHPRRGRRRHRSHRTVRRRSPRRQPQLRALSRQGLRPLALRHRHQRQAGLPGRRRQAAARPALAPGERDRQPVRGALRMARRPARRAYRADHPRPRPRQRGSHPAAGGRRSVRLGHPPVNAEVIVVGAGIVGSACAHELARRGLDVLVLDSRRGGATAVGMGHLVAMDDNPAELALSDYSIQAWRTWAADLPEDCAYRNCGTLWLAADAAELAEAERKRQALLAAGVACEMLDAARLRDLEPVLRPGLAGALKVPGDGILYAPNAARWLLERAGPRLRRLHAEVSEVDGSRLRLADGRWLSAEALVLANGIHAGELCAELPIRPKKGHLLITDRYPGTLRHQLVELGYVSSAHASSGTSVAFNAQPRPTGQVFLGSSRQFDTLDPQVEGPVLARMLRRALDYLPGLAGLNAIRAWTGFRAATPDGLPLLGEHPAQPGLWLAVGHEGLGVTTAPGSARLLAAQLFGETPPLDATPYLPQRFLSSSGSARP

SEQ ID NO: 30873 - protein, 249 aa, Pseudomonas aeruginosa
LPRRQLRARRPRRGAPGSRAPARRRSGPRDRLRTPGLRLRPGAQRATRPGPRLSPRRPGARRRRMAGRQPARPLRRRRMHRLRRQRTGPGGRRHRRPCRRRRARRGSPHVATTATLAGLRRHPGATLRPACRTASTGGGGYPGLPLRRRPLGRAGRACRLDRGQAAQPLRHGRLPGADMRQRRAIPVRLDASGAASAVQPGAPGDPGPLAGRRRLATLGAIQPAEAGQRQQQTTQQHGCQRLGEHPVRP

SEQ ID NO: 30874 - protein, 490 aa, Pseudomonas aeruginosa
HAQQRQAVGPARRPPQRQRRMPGPEHPGDAQGDPRPLPRPRSLPRQDQRQQGHQQRQQVGHQRRHARRDAEFDGLGDRRDVARVGQRPDQRLAPPLARRQPAQPGPGEGQQQRQANGEAPEAGEEHRRLFHGIAVADEAGTPGQYHAQLHGQQAGRPGHRSRGAGGRAHRSPPSVRFESRLGGLRRYYQTKLSAPVMQEIGTMSANLDIELLRTFHAILRFGRFLAAASHLNRSPSAVSTHVRRLEELAGGRLFERDNQSVRLTPLGQRFQRQTAELLETHDRVLAGLRRREEPLRVRFGISEEYAGKLLGRLLPRLGAELPALELEVLTDASGRLAGRLRRGQLDLALLVQAQDETPYDGHSREIGGTQPVWVAGHGLRIDPQRPLPLALHGQGCPYRQALLEALGATGRRWRTVVSSPGAAALEAAIEGGLAIGVIDRARVGPTMRVLGPAEGFAELPAHRIRLAFAPGERPPALERLGELIAEEFRL

SEQ ID NO: 30875 - protein, 362 aa, Pseudomonas aeruginosa
PRMSKRAFCTMAGNGSRASRMAWVAAEGFSQTARRAEVGAASPARLNRWWVSVSLHSRARAMAPITCSEARTARPCSSQVYQVTPTPASCATSSRRRPGVRRRPRREMPTRCGSMLSRRRRRKAPSCSARDGCAGLSAAWLAGASRGMAKSSEGQTGSANTRISKNWYRVSQKRMLPAHSLPHKDSAHAQHRLVVAARPRRALHPAGGATVADDRFLHRQRRPRRPRPFPRRQRNRTGTDRRRLRRGLRACAWRWAAGLATITAVAACSISASLCSPSHCCFAGWPVRSGCCWWRAPYRASARRWSCRRFSPPCMSASAATRIPARWPPTAPSAAWPSSSARCSAASWSPPTSAASAGAACS

SEQ ID NO: 30876 - protein, 140 aa, Pseudomonas aeruginosa
SSACCCRWLSAHRCTGPGPAPCCWRRRCRCWPGCGAPSCARNAARPGRCCRRRCCACRASASACCWRSCSSPAGAASCSPSPWPCRPAPVSRRYRPAMPSSPSAPPTSSRRCSPPGWRRGSARYACCCSAASSRCAACSA

SEQ ID NO: 30877 - protein, 316 aa, Pseudomonas aeruginosa
RCCSAPPASSTCAACARCHCAAIRRATEARGRALFPAAGAPYAGAAPQPGLRPDARPARRPAPRRLRQPAGQPAPGRGAARRHARRGVFRQGRARPLRPGQPHPGTPLRREGQGRTARPQRRRGLPFQPRSALCRAGSARAARRRDAGEPVGAARLSRSPAGLVPDPQAGAARCQRGDHRHGRHLPRPAGGAVGAPGLRPAGGGGCAYPRALRPAAQPRQSHCHRRALGGATGTSLQAHLPAHPTADDPQGAARRRLATARRRRADHRDRPALRLHRPQRLQPPVQGAHRTLAEPVPRDPSPAPKSVTPRPATGRR

SEQ ID NO: 30878 - protein, 607 aa, Pseudomonas aeruginosa
PPARSTAEAEGAVRRRAAPFPPVLDAPMKHAHLIVPRTLVAGSASGELLYAPTGLSFWGGVDPRSAEVIDRHHPLSGRHLHGRLLAIPGGRGSCTGSSVLLELILGGRAPAAILLREPDEILALGAIVAEELFGRSLPIACLGERFDELAAYPWARLADGRLELHRDAPPPLETRPAEALATDAGPRLDAFDQALLAGEHGEAARLAMRIVLRMAALQGAQRLIDIQRAHIDACIYTGPAGLRFAETLRDLGARVRVPTTLNTISVDQRRWREQGVPAALGEPAAALAQAYLDMGAQPSFTCAPYLLDNSARAGEQIVWAESNAVLFANSVLGARTNKYADFMDICCALTGRAPLAGCHLDEQRQARVLIEVEDLGSVDDAFYPTLGYLCGLLCDGQIPAIDGLRQRQPDHDALKAFGAALGTSSSVPMFHVIGVTPEAPDLASAFGGRAPRRTLRVGRERLRDAWRELDSAGETRIDLVALGNPHFSASEFAQLAALCHGRRRHPEVALVITSSRQVVAQAEAAGHLATLQAFGARLVTDTCWCMLDEPLVPPGARTLMTNSAKYAHYAPGLVGRQVRFAGLAGCVEAAVGGRAPAGLPAWLSEDC

SEQ ID NO: 30879 - protein, 268 aa, Pseudomonas aeruginosa
PTTSPASPKHSTSRPSAPSNTSPWPPSSTSPWPSCWCWPPACWAGACSVTEGNAVFTTSLTANDLLFLLQGAWTTLAITAMAMLIGTLLGVVFGLLRALLPRASLPLAALLDVFRSVPLLIQFVLLNSFKSILGLDWSAFAVACLVLGVYAAAYCAEVVRGGVLSVPPSVRRAARSLGLSYRQDLFHIVLPMAARVAFPGWVNLTLSVMKDTSLVLWIGIVELLRASQTIVTRIQEPLFVLCIAGLVYYLMSWVVARLGARLERRWQQ

SEQ ID NO: 30880 - protein, 370 aa, Pseudomonas aeruginosa
SATRSGRRRWNSSARCSEPAPAQEIAMRSQRIVHIVSCHAEGEVGDVIVGGVAAPPGATLWEQSRWIARDQDLRNFVLNEPRGGVFRHANLLVPAKDPRAQMGWIIMEPADTPPMSGSNSLCVATVLLDSGILPMREPLTRLLLEAPGGLIEARAECRDGKAERVEIRNVPSFADRLDAWIEVEGLGSLQVDTAYGGDSFVIADARRLGFALRADEAAELVATGLKITHAANEQLGFRHPTNPDWDHLSFCQLAAPPERRDGVLGASNAVVIRPGKIDRSPCGTGCSARMAVLQAKGQLRVGERFVGRSIIGSEFHCHIESLTELGGRSAILPCLSGRAWITGIHQYLLAPDDPWPQGYRLSDTWPGGHC

SEQ ID NO: 30881 - protein, 316 aa, Pseudomonas aeruginosa
IRIRNTKKGETMSKHVNWSGVFPAVTTQFNADFSVNLEETHTVISNLVRDGVSGLVVCGSVGENTSLTIEEKMAVTEVAKDASGGRVPVICGIAEFTSAGAAKVAKAVERVGVDGIMVMPALVYSSKPHETAEHFRSVASGTDLPVMVYNNPPIYRNDVTPDILVSLADCENIVCFKDSSGDTRRFIDVRNQVGERFILFAGLDDVVLESVAVGAQGWISGMSNVFPKEGETIFRLARAGRFAEAMPIYEWLMPILHLDARPDLVQCIKLCEQLAGRGSALTRPPRLALRGADREHVERIMAKALASRPALPDIGL

SEQ ID NO: 30882 - protein, 294 aa, Pseudomonas aeruginosa
PTPRPRRLAPRGAAGEGQRQSIPSTVPREAPCPASSVTTTSAALAAPPATSSCAASTPTAAKRCPTPSSRPPRRRSTPPPAPPNAPIHTTGNCPQRAAPDSSRRSPRASTPWATTSSPWSVARPRCPPHASRANEHVPPTSCGCSPKSCGVATSTARASIEDNPGVPRRAPTCASGESVSARWRCSVPATSRWPFPPPAATAPPPWPPAVRWWSRPTADTWPQPNAWPTRSSRRRPTAACRPGYSTWSTAAASARRWCAIRPSARSASPVRSRAGAHCATWQRRGRSRSRCSPR

SEQ ID NO: 30883 - protein, 634 aa, Pseudomonas aeruginosa
NRCPRSPSRPSSPDGYGRRWSADRGSAGWVRVRQCSCSFPLRESAKETGSGFAVRAVVPRRRSREAWRHKVSAALLSFKLFVPMPAISQADTMNLFQLRAFDAVAREGSFTRAAERLCISQPAVTGHVKALEEHYQVTLFRRTARRIELTEEGSRLVAITRTLFALEEEAEALLDANRQLVSGRLEVAADGPHLVMPMLARLRASYPGITVNLRLGNAQENLAGLLSAHVDVPVLTEVEARPGLFLEELVNSRICAPVASPASLVRTQRRRTAGRARPADHGAARTRFDHPPHLRPRLCRAGRAAAGTAGAGQPGSGDRSGGRRTGRRRGVFPGGRQRSAGSRGAAGRSRADQPPPDRLPGEAPRPTGDQGIPGTGGGLSRASAPVTLAGAAVFAEAEQRGQRIHDQLGDPGDQQGAAQAPGDHLGLEQDLVAVAGIGFHQQLMVRCAQHVPGAGVPGTLHGLPLSVEHARATHQAVEVLAVALEHRIAVAAVMPDQFLQATVEELPGGLLEALDVLRGLQAMGVDALGVVVDETGHLHPEQQAQGEQQQSQVTAEHALSSFTAAIQTRPLANTSPPHQRTHSPLCCKVQFSLSVSGSVAITVTTSSGVVSAWKSTVRSASFNRAGPNGARRVM

SEQ ID NO: 30884 - protein, 724 aa, Pseudomonas aeruginosa
WGAYDSRFCMPTRLPTDGGRRAASFIQISRPRAWPDRRGFPMPHPQPPIARRDAGSDPYAWLEERDAPEVLDYLKAENAYLDSELADQAGLRETLFEEIRGRIRETDLSLPNPWGPWLYYQRTTAGDEYPRHYRCPRPADGSLEVDEGAEQLLLDPNQLADGGFLSLGAFSISPDQSLLAYSLDTSGDEIYRLFVKDLASGAVQALPFDDCDGSLTWANDNRTLFFGELDDTHRPHKLYRHRLGEAGAELVFEEGDGRFFLHCYRSSSERQLILLLNSKTTSEAWVLDADQPQGTFRCLAPREEGHEYYPDHGRLDGRGLWLIRSNQAGINFALYQAEESRPTREHWQLRVAHDPQRTLEDVSLNAEAVILGLRDGGLPVIEVQPQGLPAYRVQLPDAAYSLYVQDSLEFDSPCVRLRYEALNRPAQVRQLNLADGTQTVLKQTPVEGPFDADAYASRRIWASSGDGTQVPVSLVARKEVLDGIAAGRPAPLYLYGYGAYGHSLDPWFSHARLSLLERGFVFAIAHVRGGGELGEAWYRAGKLEHKQNSFDDFIACAEHLLAEGYCRPEGLAISGGSAGGLLIGAVLNQRPQLFGAAIAEVPFVDVLNSMLNPDLPLTVTEYDEWGNPQEPEVHARIAAYAPYENVRAQDYPHLLVVAGYNDSRVQYWEAAKWVAKLRATRTDANLLLLKTDLGAGHGGMSGRYQGLKDVALEYAFLLKVLGLV

SEQ ID NO: 30885 - protein, 201 aa, Pseudomonas aeruginosa
TRCPAGSARSRSSARRPGYRARPRRRPGPRCWWSVRPAWASRPWSLRAGSAAGWGCCPPAGVRYPAGSGSNGRRCWRPLRDRCRRWSARPVAARCRCRHRPGAGAPRSRRPPPPAPARNRPATAPAPRAPRSCRSAPERAGPAGATRRTAPGPAPAAPGATARRPAAAPAGRSVVRQRWRRRPTTRRRARRRNTAGARRRG

SEQ ID NO: 30886 - protein, 210 aa, Pseudomonas aeruginosa
QMPGTPTTQPLRHSHRFDQGNPLAERNTRWAVLLTACMMVAEIAGGWLFNSMALLADGWHMSSHALALGLAVLAYGAARRYANDPRFSFGTWKIEVLGSYTSALLLLLVAGLMLYQSVERLLDPSPIHYQQAMLVAALGLLVNLACAWLLRDGMPTTGTATRTTTTTTTTTTIMPHRHDLNLARRLTARAGGCPPPWLLGDLLAGRRPAC

SEQ ID NO: 30887 - protein, 113 aa, Pseudomonas aeruginosa
TRPWLDPLMGIVGAVLVSVWACGLIRQSSRVLLDAQMDAPVAAEIRAGIASSPLPAELLDLHLWQVGQGKYACLLSLLTTEEGSADYFKRRLAEHEELVHITVEVNPLLPLAA

SEQ ID NO: 30888 - protein, 433 aa, Pseudomonas aeruginosa
TRYRARGTAVCAIPGIAAPGWHHRGSTGFRARSRTSPWSSAAHYIEPGAMRAFRSAPRLPMSVANVHTPPFVRQSEQGNCMKKLSGIIVLLLAGAALYLALKTSPIDPLAWDAPAAPQMTGVLEPNDTLMKAELLGQGQLHGPEDTAVDSQGRVYAGLADGRVVRLDASGKVETFVDTGGRPLGMDFDAAGNLILADAWKGLLRIDPQGKVEILATEADGVPFAFTDDLDIASDGRIYFSDASSKFHQPDYILDLLEARPHGRLLRYDPSTGKTEVLLKDLYFANGVALSANEDFVLVNETYRYRITRYWLKGEKAGQHEVFIDNLPGLPDNLQGDRKGTFWVALPTPRKADADFLHRHPWLKAQLAKLPRMFLPKPTAYGLVIAIDEQGRIVRSLHDTSGHHLRMITSAKPVGDQLYFGSLENDRIGRLAIP

SEQ ID NO: 30889 - protein, 334 aa, Pseudomonas aeruginosa
PSRNLPRLEPALSFRHFSASPRDAGMTRRGPRGMIHPSATGFASRPKESAMSSAQLLTAQQLAARLSEPDLLVLDCRFALEDPSYGARVYQENHIPGAHFADLERDLSAPVRKGVTGRHPLPDPAELALKLQAWGLRQDSQVVLYDDGPGAFAARAWWLLHWLGKRDGVYLLDGGLAAWKAAGLALTNGESSLRPGDFQGQPDASLLIDAATLQAQLGQPELALLDARAQPRFRGEVEPIDPVAGHIPGAQCAAFTDNLGSDGRFLPPEQLHQRFSALLRGRPVDELVAYCGSGVTACHNLFALSLAGFPLPRLYAGSWSEWITDPRRPVATGD

SEQ ID NO: 30890 - protein, 201 aa, Pseudomonas aeruginosa
EGSSMNVKSRQQENAEATREALLESALSAFIEHGYGGVSIDAIAREARVTKGAFYHHFGSKQELLAECYERQVRTIAEDLDRVPAHVDKWAEAAALAEAFIDSVMARGKRQLSLQEVITVVGWERWKRIDSRHTLRYVGRLVDELAASGELKDYRRETLVGQLYGFLTQAAMSLRDARNKRQAANEVKAIIRDFLYSLRRG

SEQ ID NO: 30891 - protein, 554 aa, Pseudomonas aeruginosa
TCATARPSPGRWWKPRDCHCPTSTTTSPRLACGARYSSRTVACTSSSTPGNAASAASARSPDGEWKNPASETDQPVRKFFTYRHERLRYLRFTGTGANRSVPHPAELRNTGAGLGILVVCAPLYTGVAPTMKTIWFKTSLALTISAVSTYTLANGIAINEQSASGAGTAYAGRASSALDASTIYGNPAGLSKLKRTEVSGGLAIVKAKDDISQAHSTAQGSNKGDSVPLAAVPFGYFSTPINEDFTFGLGIYVPYGIINDYENGFMGSSHGSYSKVQVITVQPTIAWKINDKVSVGFGPTFNRIDGQLKNTLATNGLLGSNGDTKINIKGDDTAIGYNVGVMVDLTDDTTWGLTYHSKVKYHLGGNTEVKNAPGALGLNGKYDAKLDITLPESVDTSITHKFDDKWTGYLGAVWTRWSRLEKIEVRNSGVPALGQALGFNTIGEDLNWRDTWSFSVGTSYQATPEWVLRTGFAYEPSPTSNEDRNVRIPVGDRKVFTVGAGWSPNQDLTVDVAYAYLWETTAGVNQEGSALQPAYSAKYDNSAHGLTAQVTYRF

SEQ ID NO: 30892 - protein, 503 aa, Pseudomonas aeruginosa
QDRQLPDQVVAAGAVVDHPAQPAAEEGAQLVEEEHDAAEHRQVAHAEQGRHGAVGQGHRGQPQQPHGHAEGVGAVDAQRQPEEQHDHYPAHQVQRGQQARLRPAPAEPAGDVGAEHVEQPDQRQHRGADMRRQVLVDQVGRQVYADEHHLEAADEEAQRQQPEPGMRAGLAQRFAEALFMALRRQRAILHQPGQRHDQRHQQAQGEQGRGPAQPADQGEGTGQHGELAEGAGRAGDTHRHAALLRRHCAADGAEDHRERGAGKAQADQQAGAQRQPTGRLRESHQDQAEGVQQAPHQHRPRRAVAVGERPGERLGQAPDQVLQGDGEGEDFAAPAEVGAHRREEQAEAMSHAEGQGEDQGSGQQDPEGGTRHGSLHLRVYTRFIVNEAPRREASSVVSPVAPVPPATPPRRRCAPRQGARRDAAARLPRPAFRAPGHPARQASARPGGCAGPRHRSGAAGRRLPAPAGCDRGCCGRVPWLRRVRKCSAGPGAAGAAAGKTAPP

SEQ ID NO: 30893 - protein, 308 aa, Pseudomonas aeruginosa
  UNSURE (109): Identity of amino acid at the above locations are unknown.
GCPRPSCRRGSATASTTPCWSPRAWRRRSRRGSSSLPGRLSTRPSSPCYWPPPRCSSSAPWRSCASRVRLQSQRHQHRTLGKFDQRAGGVPGGAAEAREETAAQPGEEXQRHQQRQQAGQAERQGQAETHPQHPRQAARRQVLGDGLAEAAGARVWRGQEQQRQAAARQPRGQRQQPGLALAEQRRQGGELQQQDQYQDHHRHRAAARVLHDRQGPLAVAQPADPGVRHVGQAVQVQRAAQRHPQAQQQGCLQQLRRTIERQSRGVQHDADQHPDQWIAEHRAAELFRRRHRRQAHRQAGEELQGDQQ

SEQ ID NO: 30894 - protein, 287 aa, Pseudomonas aeruginosa
GSAQKRPSASLWPSIRAAAERPSQAPKCSSRRSFSSSSSIPWRCASSSAKARQRCNGELTSRSQRPPSTAVRICAQPRAVKASSRLPRKPPPDSVSPCRRRSRRRLMPGGPRPPLRRRSPSPRAARRPGAAAAPPAPRRYPRPGAGRGRAAVAPPGLRAHGDGPARHRCGRTAASRGRPGSGAPRRAPRRCRCSRRPGRPCLSARRPGRRRPARRSPGHRDGGGFRRGRRDGRRAGPGHARSPRPCAPRRWRPARFPARPARSPAHPAARRPWPPPRWYCRCPSRRR

SEQ ID NO: 30895 - protein, 81 aa, Pseudomonas aeruginosa
PPADRPRCPRRLPRGRRRRPSPRSSPGSVVRAPATPPGRSPLAPGGPASRAAWSTGPGVRPRAGASAGPPRGRCRATIADS

SEQ ID NO: 30896 - protein, 133 aa, Pseudomonas aeruginosa
PRHGSRSPTAAHPPGSGGPVRCAIACPPQGSFPTPAGRGQRCCRPRLPGRADRAGARRASAGRRRSPAGDRRSAGDGGSPRPSRARAAPRGRRARSSSRAGRSGPPTAAPGRGRRSSTRPGGAGAADRNRCGC

SEQ ID NO: 30897 - protein, 332 aa, Pseudomonas aeruginosa
RRAASRNRPPCSSMQPPHGPESGQHQQPEQHALAYQRQGPIDVAALRLRAAAEERPLVQLAVVDRRAAQGHAQRTGAGGHHRAGVGAVPLRRLLSPAAQGLAGAAEQRVGQRHQPRRQVVEDVVDLRRSPAEALEARVAVAPHRVQGIAQAIQHHPRRAGHGEPEQGGVNRVAAVLQYRLGGCAGDPGLVQFAGIAADQVADTSPRLVQVAGAQGQRHRFGVLAEAAQAERGVQRQGLDQPAEVGKFSERPGQQGQRQYREDPGGHPVAAPADPGIGLAGQARAVETALQAIGQAAEGDQRVPALRLAEARIQRHAEDTQQCAHARSPQRFW

SEQ ID NO: 30898 - protein, 171 aa, Pseudomonas aeruginosa
NSATGPRQSTATASLPGGRPSSSPSAAGSNSDTQPIPRPSARLASQRLWIAQASDARSICGRVRRPNTWRSRSSIRAATSSSAQSSTPSTLSRMNSSERSPRASAVRPRSSSTSPWMARRNADSVIRMKRQGCIRPTLGAWCAASSSRASSSGATLPPLKWRMSRRSAMAR

SEQ ID NO: 30899 - protein, 471 aa, Pseudomonas aeruginosa
TAARSVALKAWEESDMSVGVSRGRQQRGGGLRVGRQVEMDIGSRQPAKTEHRLRRVPAVRADATGQRLDGAVEGRVMEGMPAQPPFRQLDLLQGQGGQALLQARPARQQAEQFAALAVGVFQAVEQVEHAAALGQQRLAGGMVGSDRLGHGAIALQAPQVQFGIAARQVQAVHGGQRLVLQRREERQFGAEFAQQVEIGLVEEGERGVAGHADAHAFQATLQRRRSGHLEGHRLRQVGLGAGPQGVGGGVQAHIEIGQFLGLDQAQVAARQFEFGRARQTAEPAHTGRQAITQDVAVALAADAVAEHSGKRQVRLEMRQSVGQRAEGLGHRRAVDHPQHRHAETPRQVCRRGVAIEQAHHPFDEDQVGLAGGPRQQASRFGLADHPQVELVNRRAGGAGEDHRVEEVRPALEHPHPPPLARMQAGQGGGDGGLALAGGRGGDQQGRTACLGHGRSVSAHGAGIRIPLLSAP

SEQ ID NO: 30900 - protein, 252 aa, Pseudomonas aeruginosa
HAQGLGTGAAERTLEPSVVALGVRRGDPPQRREQLAAFVGAAQLRRGRLQAGLPGRLALVRQLAFQAPRPEQHTHQRRAEDAQADLRAAGHRLVEHRRRIGAGRQGDDRRGVSGQDETVRRMVVHQRRAGGAERQPERHQKEEGQRRLTIQRDHADGHQRTGAGADQAEHALGQDHAAIGLADHEHRHQCPLRLLQLQAEGQVQGQPAGQQGLHRELQFVQTRAQQHLHQVGGKEGRLGHRGRPEIHERANY

SEQ ID NO: 30901 - protein, 339 aa, Pseudomonas aeruginosa
AKTLKRPAPPKRHPVAHTPAQARATMQRIRIIDSHTGGEPTRLVIGGFPDLGQGDMTERRRLLGERHDAWRAACILEPRGSDVLVGALLCAPVDPEACAGVIFFNNSGYLGMCGHGTIGLVASLAHLGRIGPGVHRIETPVGEVEATLHEDGSVSVRNVPAYRYRRQVSVEVPGIGRVSGDIAWGGNWFFLVAGHGQRIAGDNLDALTAYTVAVQQALEDQGIRGEDGGAIDHIELFADDPHADSRNFVLCPGKAYDRSPCGTGTSAKLACLAADGKLLPGQPWRQASVIGSQFEGRYEWLDGQPGGRIVPTIRGRAHVSAEATLLLADDDPFAWGIRR

SEQ ID NO: 30902 - protein, 534 aa, Pseudomonas aeruginosa
PPRRAARACSPPSCSAKRRRWMPRLICRNASSPAPGVPGHDRTVHRPASAAGRRRHQRGGRPRPRRRRLLPQRGRRRAARAVLRHGRVPGMPGIDRRSATPGLPDRLPIRHARGDPGMSADYDLLIVGAGPAGLAAALAAAPSGARIALVDDNPAPGGQIWRDGPRASLPPRAHQMRQRLAGQANVEHFPATRVVACGPGRRLLLEDPQRGWQVGYRRLVLCTGARELLLPFPGWTLPGVTGAGGLQALAKGGLPLAGQRLVVAGSGPLLLASAASASQCGARLLRVAEQAPARTLAAFAVRLPRWPGKLWQAAGLFARSYRADSYVLAALGEERLEAVRLREGGRVREIACERLACGFGLVPNVQLGQALGYRLDGPALAVDEWQAGSLPDHYAAGECTGFGGSELALVEGAIAGHAAVDERDAARRMWPRRRRWQGFADTLARHFALRAELRQLAEADTLVCRCEDVPLAALAGHAGWTEAKLHSRCGMGACQGRICGSAAQFLFGWTPPAPRPPFSPARLETLARWQGDAG

SEQ ID NO: 30903 - protein, 173 aa, Pseudomonas aeruginosa
PRWGSGSSARPPSCWRPTTACSPGCADGKSRCACASAFPRNTPASCSAASCHASARNCRRWSWRCSPTPAAGWPDACGAASWTSPCWCKRKTKPRTTGTPARSAAPSRCGSPATACGSIRNARCRWPCTARVVPIDRRCWKPSARRAGAGARWSAVPARRRWKRPSKAAWRSA

SEQ ID NO: 30904 - protein, 628 aa, Pseudomonas aeruginosa
ARTGTGLARSACCQPTPFRTRTPPMPSTVSSSRLGLAGLCILLAGQLLPMIDFSIVNVALDALAHSLGASETELELIVAVYGVAFARVPGDGRPAWRQLRPSPPVRSRRRSVRRRIVALRAGRFGLAAVGGARHTGRRRGAGRAADSRHPACQPQRPRAFPRAGRLRRHRRPGLRRRPGARRLPGLRRHRRPRLAQRVPDQPADLPRHSPLQPPLGTGNPRRACRPHRRAGHPAARRADPLPAAAVGSRPIAALVLALRPAAGGGGAAAGLAVAHRAAPGTPPGLAVAAAVAAAPAEHPLRPVAGDPVLRLLERLLVRPRPGPAGRRRSLAGTGRQCLHRPRRLLLRLGAAHRQGGGAARPGTPAAARLRHPDVRPARPDADPATGLAAAGHPQPGAGDPGDRLRPGVHRQQLLPHRPLGGAGRPGRRRQRHARHRPAGLPRPRLGAARRGVRAQAGAPWRLPGSDADDPGRRVRPDDAAARRHLPLLPAPRAHGAIALRFAGQLRRAAGPYSRPPAPRMLARPPSQAFAPMHDLLAAPPPADFASLLASLRQVEALLDAMPGVVFFVKDERARYVLVNRTLARRCGVKDKAELLGRSADEVFPSSLGPLYAEQDRRVLRGGATLENQ

SEQ ID NO: 30905 - protein, 155 aa, Pseudomonas aeruginosa
ELHVYPGRQPGWCLTHKQALRDANGAIIGMAGISHDLPAAQSAHPAYGRLAAVDAHIREHYDQPLSLANLTAIAGLSVAQLERHCKRIFQLTPRQMIHKARLGAASQLLAGDAPITEIALRCGYTDHSAFSRQFKALTGLSPSQYRETHRQPRKA

SEQ ID NO: 30906 - protein, 145 aa, Pseudomonas aeruginosa
STSSARTSTLASTPARPACASPKPCATSVPGYGYRPPSTPSPWTSAVGANRAYPPPSASQPRPWPRPISTWARSPASPARPTCSTTARGPANRSSGPSPTRCSSPTACSAHAPTSTPTSWISAAPSPVARRWPAATSTSSARRGY

SEQ ID NO: 30907 - protein, 138 aa, Pseudomonas aeruginosa
SKWKTSAASTMPSTRPSATSAACSATGRSRRSTACGSGSRTTTRSRPSARRWAPVPRCRCSTSSASPRKPLTWPAPSAAARRGGPCGSDASACATPGASWTAPARRGSTWWRWATRTSPPANSPSSPRSATAAADTRR

SEQ ID NO: 30908 - protein, 264 aa, Pseudomonas aeruginosa
AGWSRDSAPGWNGDGSNDRDQRRAQGLRPVRGGQGRRPEGGQGRGAVDHRRLRFRQVDPADVHQRPGADPARQHPRRRHRRACPRYRPQPPAAEDRHRLPAVERLPPPDRAGKRHARAAQGARQEPRRSRGDGAEATHPRRSRRQAQGLPPAPFRRPATAHGDRPGAGDVAGIHAVRRSHLGARPAVGRRGGGHHAHARRGRHDHGPGHPRDPLRPRRVRPGGVLPQWPGPRDRHPRPGDRQPAAAGDGGIPPLGALSPPPHRR

SEQ ID NO: 30909 - protein, 631 aa, Pseudomonas aeruginosa
CRSSISTPVPTWCSASSSASNSPVAAAPSPVHRAWPCAAPIASTSSGSWPRPWPAGRRCRTSACSRRPALAASLPGERPARASGRAFRPPSPGRPHAQHPRSQLRRRRSQRRRQPHPAQPRRRQRRSAALRLRPGHRGGGRRRRPRRRTRLSTLPATVRNAPRRIPRGDRLAPRRPGRRLRRPGPSRDRAARRTHPGRTNTYRQPVAAVRRSPAAWRLPRRAHRSRTTRAYPAAPRPAPVANRSRPGGGVRCQQLPAGLFHRRRRQRRRPGRRLSGGGQGPRRTHGHSRMRGRRDPPGGGRQRHAGRGIQHGLRQRRRRGAGAPSGHPRGRLHRFAQGRARTVRPGSGAAAADPGVRRDEQHQSAGGAPRSPAPARPAGGGGAGRLGDARLRPVLHQAGPGAWPALPRLRRLRRGPGRGTGRQAGTEHAQRRHLAQLCRRTATPGAPPRHPAPGRRATGRAAGPSAVVQGRRGPVAGRRRTAPGRGVWPGHRGRRGGRRGTACPRAGQPARPVVGDPDRRSGRPRGVRRAGPAARTQGRAPAIQRLSDRRRGVRRHGPRRPLPGHLRRSRHLGGNPGHRAFPAPAVLPGLPRQPAPGRPEERQPAGPAAPGRWPEHARGAGLSTPGSLDGG

SEQ ID NO: 30910 - protein, 545 aa, Pseudomonas aeruginosa
QAPGLAFEQRDQPGERREVVRFADQGRRQLAVQVVQRAGKLFLVGRLDDHGGRAKHLFLEQFVAFQQQAHVGLEQLRMGLPPFLWRAGQAPDAGVALQALQSFDIAAQGAGVEHALCRPGGQCLAQGRDEGVEAGGAQAKHQARLGAELAAAERHRGGQLLRHLPAAPAQGFGEHHQRIDAAHLGEHRDRLRPRRCQVAQCAPALERTGEADRADGRMAHQRLADAAAVDHVEYPGRHAAVGRRLEDRVGHAFGCGHVSAVGLDHHRTAGGQGGGAVAAGGGKGQREVAGTEHRHRAETDSPLAQVGARRGTPGLSSIDARAVEVATPQDFGEQPQLVGGTCSFALDACGGQRGLATDQGDEVVAQGVEARGDRLEESGAARCGQLPVVWIGAFGGAGGGVDLRLGGLDEGVGQRFAAVGVEAAQDEVAGGAASAADVVVTEDAGHGASLGTVDGMLCRWPSPAAPRGARRRGRGVGYKPMSGSAGRLARALAMIRSTCSRSAPRRARRGGRVRALPRPASCSQSLMHCTRSGRASRWRIGISHS

SEQ ID NO: 30911 - protein, 436 aa, Pseudomonas aeruginosa
AVSTCSEPRPSTSIQASRRSANDGTLRISTRSALPSRHSARASISPPGASSSSRVSGSRIGRMPLSSSTVATHSELEPDIGGVSAGSMMIQPICARGSLAGTSRLAWRNTPPRGSLRTKLRRSWSLAIQRDCSQRVAPGGAATPPTITSPTSPSAWQLTMWTIRCERMAISCAGAGSEHRAEEFHRLRPLRVADHLVGGADLVDQAIAEERHPVGHVAGEADLVGDQDHGHAFLGEHAHGVHHLADQLRVERRGGFVEQHVFRRHRQRPGDRHALLLAAGKALGEDLELVAETDVGELLQRHRLGFGAALAEHLARREHDVFQHGQVGEGVPLLEDDADLPPQAVEVGTAGMHVDAVDADAAALDRLQAVDAHQQGRLAGTGAADDRQHLALVHPQVDALDHLELAVGLVHAADLDHCCHLRSSRAPSRATTQLMR

SEQ ID NO: 30912 - protein, 363 aa, Pseudomonas aeruginosa
AAAYTPSTRQATAKALQSRPRMLLKELSRTNWISSGTLRNTSSSAASGRLARGSRARSRPKTTPSRVPISIAMAVMARVVQAPCRRNSRSLAVRLVVNTAFPSVTEQAPAQQAGGQHQQLGHGEVEDGGQGEVFEGAEGLDVECLGDAGEVVGQAHHHAEGGHQHGPDQLVGQRVEHHPQQLRDHHQAIGLRRAHAQRAGRPQLGLGHRLEAAAEGLGEVAGVVEGDPGEQGEPGTDVQAEGAQAEVEDVDLEQRRGIPRDGDPGSGGGAQRAVTAEPGEGQEQGDEDAEEHRQRGDLERHQAAGEHLRQGVERRAPVEGVVEHQQSSLNQAGSPAGARPPTAASTQPARPAKRTWRPTSPGA

SEQ ID NO: 30913 - protein, 511 aa, Pseudomonas aeruginosa
RKTPRRAWRRAAPRPGAGWPAGWRSRRGAGRRAGRASGRRPGWGAAPAYGAPAAGNRARPRASVARRIAAQWHRAHAAQVEEAGGAEQQRHQDELDGQGRLRRFQVVAMALQPVREHRAEQRRAEAEGGLLDGGEHGAAGAGLGGRHLREADAEEAADDERLAEADHQGRRRQVEDARLRPDPLQGQHQAEQAAHLDDAAEQQQAYRAEPRRHPGGEQRRDEVGGAEGDEGIAGLYRRETGAGLQGQGEGEQEAAPAGEEQDRQQQAEADARQAQQRRRQQRPGLAAFLAQLGAPQPGQQRHRRRQQQGAGPGPVQRWAESQRQQQAEDQRGEQQGARRVDAGGMLGAGFRYPAAAAKENAEADRQVDQEHAAPAEAADVGGDQEAAEHLADDEGQAADGAVGGQRAGMRVAAEADMQGGENLRHDQRRADALYGARHQQQPDRTGQPAKQQCDGEQSDAEIEQAATAVIVAKPAAHRQAHARRPRRRRRRSVPVRFRWRRGNGRGRRGRR

SEQ ID NO: 30914 - protein, 358 aa, Pseudomonas aeruginosa
RWRNRSSATVAPPAGCRARRGRAATTRRCWAWAESLCGREWAGSMRFWLTRYQFLLILVLALPVCPSEDFAMPLDAPASHAAESPAQPSRAEQLGAFLRRRRESIEPQRVGISRLGRRRTPGLRREEVAQLAGVGVTWYTWLEQGRAVRASEQVIGAIARALLCNETETHHLFNLAGLAAPTSARRAVCEKPSAATQAILDALDPLPAMVQNARFDIRGYNRAYCRLVGIDLAEIPEEDRNCIYLALTHERWRYCMANREEALPRMVGFFRAAMVERMGDPLWERQLQRCLEASAEFREIWRRNEVMGIENQLKRFRHARCGEFELQQTNWWSAPKNGDRLLVFVPLDDHARDCLEQL

SEQ ID NO: 30915 - protein, 192 aa, Pseudomonas aeruginosa
VGALSRSQRLLDLLQILRRHRYPVAGHVLAGELGISLRTLYRDIAILRQQGAHIEGGAGARRCCASGVNGKASPRSERLLPETDRRPPPAGLAPGAVAAQSRNSSAISSPRRSSAGGRSPGAKARRMRWAGSSAKPSAGPSTRIVGPTRARSITPIARPPSMAASSAAAPGLLTTVRQRRPVAPRASSSACR

SEQ ID NO: 30916 - protein, 208 aa, Pseudomonas aeruginosa
GQPWPCRASGSGRCGSIRRPWPATHTGWVPPISRECPSYGVSSCACTSRARSSWPRRRRPASLPLASVSTSSSSAGSSAPRRGRRRPSSLPAYSSEMPKRTRSGSSRLRNPASTRSWVSSSSAVWRWNRCPSGVSRTDWLSRSNSRPPASSSRRRTWVLTAEGLRLRWLAAARKRPKRRMAWKVRSSSISRLALMVPISCMTGADSFV

SEQ ID NO: 30917 - protein, 277 aa, Pseudomonas aeruginosa
TADAAPEASSRTGIARRCRISAPGRRPCRNGCAAWPRSSRHARPARPRGRLRNGRPGYPPPPVDAVRHAGRSVAPGCLRSPASVAVVATCGEPRRARRRRHGRRWRLPPGPVRCRRSRCIRRRRSGRAGCRPAIRRRRAPGRRGDSRGPGRVARWAPGRSRRPGVRRRSRGPDRLRAGARLPGAPRRGRRARSCRRGSYGRTGRRPATACRASAGGVRRRRPGFSPAPVRRRAAGAPRTGWRWRRWPAAAGRSQPPPGAGRPVAGRPWPTPAGRRRR

SEQ ID NO: 30918 - protein, 214 aa, Pseudomonas aeruginosa
RRGGSSREKAAAVRGRRCRGPGVGSRPASHVAGLPATGACRDRRRPPGSPGSARHWPARPGVGASDGHAAAGWHAGRRARSVRRGPGCRRPGRCARRSARRPALRPGRRGRHRRSAGRSRRSCLGLHAHAGLADGLAGQASPTVDQYPAFLARAHAAERRAPPAADRAAGAAVAAEGEGGRHAGADGDPQRTPVDEQFDHGRALPELERKRCGR

SEQ ID NO: 30919 - protein, 72 aa, Pseudomonas aeruginosa
GVASSGGVSPNNWAASRRALPGAVVTPRPSWPTASHRPGCAGCSPSSGRPSGVAARKPVQARIALRPASPGR

SEQ ID NO: 30920 - protein, 420 aa, Pseudomonas aeruginosa
RHGPGQGHVPPDRHLRRCAGVHRHGRAVWSGVAALPPSDGALAGVLHRRRVVDAQPCVVRFRPGRIHRGDRRPAGQRRSGDGVRPGGGPLLGDRPGHPLRGAGECAALAAAPGTPVGEPGQGGPGGRLAGGRGGAARRRRTRRAARGAGADLRGGRPARPRLVRGCARPRPFPGLARARPRPARPAARGAQGGSRAEAARSGQRARLAALAGRTRGTVARGPPGRVRGLPAALAPGAGRGARTVAPVPGLPRTPARRGEGGRAQRRGAGLWRAHPPGAGRHRLAPGHRARRAVRPAQRPGVPLRSRVLAGQRLAERVGRGVDHRRGAESLRQPRQPGPGRPELPSRDSPVDPAGRLRRTVLPARRGRLPAALPGPGRTAVLRRAVREPGEPGRDRLAVLHLLREKRRAEQQHELRPRALP

SEQ ID NO: 30921 - protein, 617 aa, Pseudomonas aeruginosa
SMNRVFLTPAAVALCGASSLSLAEPVSLADQVVTATRTAQTASQSLAAVSVIDREDIERSQARSVPELLRQVPGVSLANNGGFGKNTTLFLRGTESDHVLVLIDGIKVGSASAGLTAFQDLPVELIERIEVVRGPRSSLYGSEAIGGVIQIFTRRGDGQGAKPFFSAGYGTHQTLEGSAGVSGGAGNGWYSLGVSSFDTAGINTKRAGTAGYEPDRDGYRNLSGNLRGGYRFDNGLELDGTLLRAKSHNDYDQVFGNSGFNANADGEQNLVGGRARFTPFDPWLVTLQAGRSEDKADAYQDGRFYSRFDTRRDSLSWQNDLTLAEGHVLTLGYDWQKDEISSSEAFSVDSRLNKGWFAQYLGQYGRQDWQLSLRRDDNQQFGVHDTGSAAWGYALSDALRFTVNYGTAFKAPTFNELYYPDYGNPDLDAETSRSLEVGLSGTHGWGHWAVNAFRTNVDDLIGNDPRPAPGRPWGQPNNIDEARIRGVELVLGSQWLGWDWNANATFLDPQNRSGGVNDGNELPRRARRMFNLELDRRFERLSLGASVHAEGRRYDDPANKVRLGGYATLDLRSEYRLNDEWRLQGRIANLFGADYETAYGYNQPGQAVYLSVRYQAL

SEQ ID NO: 30922 - protein, 205 aa, Pseudomonas aeruginosa
STMNESPEKDQRHRERMERKKAVIDEKIAQARDERGVLLVHSGNGKGKSSSAFGMVARALGHGMKVGVVQFIKGAASTGEEAFFRRFPEEVSYHVMGEGFTWETQDRQRDIAKAEAAWKVAAQLLADPDVGLVVLDELNIALKHGYLELDRVLADIQARPAMQHVVVTGRGAQPGMVEAADTVTEMSLVKHAFKAGIKAQKGVEF

SEQ ID NO: 30923 - protein, 416 aa, Pseudomonas aeruginosa
TSLPRLVGPGPGAVRRARPAQPRRARRTGGAGLARRRPGRGAATCRLPGQPRYPRTGPGRGRPRSHRVGTGERQRRGLRRPVLVRRGRRAGGGAVSPEQYPGRDVGLPQRALRALRLGCGEDRRHPQLPAGAAGGADLRAARRHPPGPALLARAGAAMGQPQRRPGDGRRRRCAGRVPGRRGDLPRRAAPAAAPRQRPAAAGPRHLSGPGAGTPGRAVLAAGAGRTLGHGVAACLNTEGGCARRRAATTFRWRTGWTCPPASRPGRFRCRRSPSRPGPACRRATTAWKPLPASTTAPNGYCRWPAARRRSRPCQGCGGAGGSASCRRAMPSTPTPGARPGTWCGRSARPRSSPISTASTCCWWSTRTTPPGGSSSPPSCWPGMPACNVAAAGCWSTRRSWTAPRSRAWRPVSTDPD

SEQ ID NO: 30924 - protein, 635 aa, Pseudomonas aeruginosa
SCCARSASSSAWPVRGSASPSANGRCCRRWPSSSARGRSMARCAMWPRMPCATASNSASSASACWPPASAWRNCCAATAGRRRAAARCSSAWSIHAARRCTTTWRGAASSPASSSSRPACASACPPTRPPGPGWMPRCSASRSLLMSDRGRTLMVQGTTSDAGKSTLVTALCRWLARRGVAVVPFKPQNMALNSAVTADGGEIGRAQAVQAQACRLAPHTDMNPVLLKPNTDIGAQVIIHGRAVTSMDAAAYHDYKRVAMEAVLASHGRLAAAYRVVMVEGAGSPAEINLRANDIANMGFAEAVDCPVILVADIDRGGVFAHLVGTLELLSDSERERVKGFVINRFRGDIALLQPGLDWLEARTGKPVLGVLPYVSDLHLEAEDAIDTRQAAKVGPRLKVVVPVLPRISNHTDFDPLRLHPQVELSFVGPGQALPSADLIVLPGSKSVRADLAALRERGWDEAILRHLRYGGRLLGICGGLQMLGERLHDPLGLEGAAGSSAGLGLLALETTLEADKQLRNVQGRLSLEDAPLSGYEIHAGVTRGEALARPAVVLDDGRADGARSVDGNVMGTYLHGLFESTAACSALLRWAGLREVQAVDYQALRERDIERLADLVERHLDTGRLLALCGEPHA

SEQ ID NO: 30925 - protein, 521 aa, Pseudomonas aeruginosa
PDPWRRPFRQEPPGRAPGRRERAGGELHRHRPGRRRRNGPAHRRAPRAPPGPLANPGGASGAGGDAAQRGRGRTLPAGRLPDPVADQPAALRRSPASRRRARGAAGMSRRAAGTDHPGQQRNRARRGAAGRTQPALRRRGRLAAPGHRRTLRTGDLHRRRPAHAVERRTAMSLQWWRDTCREADPQMRRRAAERQDRLTKPRGSLGRLEQVAIDLAALQGRERPSLERIWVTVFAGDHGVVAEGISAYPQAVTGEMLRNFVRGGAAISVLARELGAGLEVVDLGTAFPLEALPGVRHLRLAAGTANFVEAPAMGAEQCLLALEAGRESVRRAEQAGSQLFIGGEMGIGNTTAAAAMACALLDAPASALVGPGTGLDASGVAHKAAVIERALALHGAHRADPFETLRRLGGLEIAALAGAYLACAQKGMVALVDGYICSVAALCAVRLNPACRDWLLFAHSGAEPGHRHVLEALAAQPLLDLGLRLGEGSGAALAVPLLRQACALHAGMATFAEAAVSDRPA

SEQ ID NO: 30926 - protein, 371 aa, Pseudomonas aeruginosa
  UNSURE (259): Identity of amino acid at the above locations are unknown.
PMAASYACCSLAPVACRASACCRWTSVMAHCSACAPERATIAGTNAGKGNSHARSLALTAGRLAVPHPPAGAPVGDADAGTVRPRGALLSTGRGADRRRAVRRGSVARWYAAAVAGSLAAEPVGGAERRAAPGRPGRHGGRLGRRAGRPRADPGDHEGPAQRPGGGGGPGTGPVVEVLLPGGAARPGRGRVVAAGPVAGAQQPAAAVPDHAIRAPRRPRPGHRRAPAGAQPAVGAGGEFRPGPGVRPGRPAGVAGDADXLRLAAQPFPRAPRRHHRGHRRRAGRTYRVCGAGGAGSVAGRGWRRTAMALRKSSAAAASSTATKAWSKACRASSTSRDATSGARPSATNRASSRLSRTRAGSSAEGSLSDIP

SEQ ID NO: 30927 - protein, 295 aa, Pseudomonas aeruginosa
DRARPSNPALPSSREAHITRFSPQRGTSQPASGPTTSEASGIGRTNRPAFSGVRSCTSCRCWLNTSSMPTSAMVATRATATPRAKRRLRNSAKSIIGSRARRWRRTNRYRQSMPPSAARTTSPKSGARVLSSLIAYTTPTRPNITCSEPRASHGRRDWPPQAGMAGSASNKATTTTGTLMRNTEPHQKNSSSTPPTTGPSAAPAEATEAQMPMARARSRSSWKTWRTIDRVAGIISAAPTANPARAAISAAALGAKAAHSEARPNSGRPARNSRLWPRRSLSKPAPGSRPATTSG

SEQ ID NO: 30928 - protein, 191 aa, Pseudomonas aeruginosa
TQEVAMGRRRTIDRDQLLDAAEAVIGREGAAGLTIDAVAKEMGITKGGVQYCFGTKDALIDAIFERWGKAYDSLFEAVAGKQPTPLTRVRAHAEATQRSDELSSSKAAALMAALIQTPEHLEGSNQWYRSRLEGLDLSAPEGRRARLAFLAVEGAFMLRYFRLMDIGQEEWDSMLDDVRALLLTPAGASGD

SEQ ID NO: 30929 - protein, 195 aa, Pseudomonas aeruginosa
TGMATSAMDGGRRVLPVAADSASYRPAPGVRPWQGQQTALAVRTIRLTDERYGYIHASMLPTQCLCTKLRRAARSVSRFYDEALADTGLKVAQFSLLRHLRRLDRPSISELAEAMGLDRSTLGRNLRVLEGDGLLRLTGGEDQRNRLVELTPAGLDALERGTPAWEDAQRRLAGRLGEERSGALAALLVELERLD

SEQ ID NO: 30930 - protein, 203 aa, Pseudomonas aeruginosa
VAIGAGKGKLGHSSPRSHSMKPRVLLSVLALAGLPLSGWAADCPELLQGQLTKLRSKENIDLCQRYAGKPLVVVNTASHCGFTPQFKGLEALYQRYKGQGLEVLGVPSDDFKQEAADTAETAKICYGNYGVTFAMTQPQHVRGDEAIPLFRQLAEQSGQAPRWNFYKYVVDRQGRVVAQFSSKTTPDDPQLQAAIEKAIASQP

SEQ ID NO: 30931 - protein, 140 aa, Pseudomonas aeruginosa
RRRGHRRPRWRGFPPCPADRCAAGLSRRRRGSGCRRHRSPCPAGGRRCRRRSRPCRWRPGVPRGRRRDRHRRGPGCPRRCPRGRATGPGQAARPSSGCRWVRGPRSSAERPEHPRRAGRSGWSSGPGKEPRQPAGGRLFR

SEQ ID NO: 30932 - protein, 521 aa, Pseudomonas aeruginosa
ASSCSSLVRIVGQRAEYGHSLRSSASAVPSGMLAWRQALYNAPHLTKEMFVTAPEIQWIRDDASLAQQCREWRTQPYLALDTEFMRVDTFYPAAGLVQVGDGRQEWLIDPLLIQDWSPFAELLEDERVVKVLHACSEDLEVFLRLTGSLPVPLFDTQLAAAYLGMAHSMGYSKLVKEVLDIDLPKDETRSDWLQRPLTEMQMRYAADDVQHLAQVYLALDARLSEEKRAWLLEDGAELVANLCRESDPREAYREVKLGWRLRPQQLAVLRELCAWREEQARLRNRPRNHVLRERTLWPLARLLPKNKTDLAAIEDMHPRTVRQDGDFLIELIAQAARLPQERMARGAARAAAAGGHPAAQEPARHRPARSGDPGHGARTDAAQESPRGTAQERLSRRSLRTARFPPRLAPRTHGPGPAGRPGERMKRICSVYKSPRKSEMYLYVDKREALSRVPEALLVPFGAPQHVFDLLLTPERQLAREDVAKVLENIEKQGFHLQMPPGEEEYIEHLPEELLRMNDPL

SEQ ID NO: 30933 - protein, 176 aa, Pseudomonas aeruginosa
SSHVPAGAWPGGGGGLDYRAFSPAPDAMAAKVEPFWKRKTLAQLDQDEWESLCDGCGLCCLQKLEDEDDGSVYYTRIACKLLDLQSCRCTNYAERIRFVPDCIQLTPAQADEFQWLPPTCGYRLVAEGKDLPLWHHLVCGDPERVHKERISQSGRMLSETQVAEDDWEDYLIFRAG

SEQ ID NO: 30934 - protein, 148 aa, Pseudomonas aeruginosa
ALPWFRLACLSGVPWRVAALPAQAPGQFGGRRRPRPGYFRPVAEMAGPAIGRAAARISFPDRPQPVARPLAPAAEPRPGSRPAGGERRTRRAGRRGGRAGRAFRTAAASQPPGGRAGRAAAAAARSVRPAQVRRPVPGRSGRAHGNLP

SEQ ID NO: 30935 - protein, 1245 aa, Pseudomonas aeruginosa
AWWKSTSPAPCCTASGGLAREAKDEAAGTTGTAVRRRNRRGHRSPRRLLVQPASFRAFQRCLPGRAGGLATRRSAPSRSARGHGAALARIRRPAAPGAGRYSRAGAGLAPAPGAGGGVLRVLRAARRHPVLARPVARTEPRLRHGTWRAARGGPGGRIEAVPRRRYPGAGALRRAHPRRAVEERRGVLRGQPRSGPAFPGRQRRQPGHRTRYPVQRPAQRAGPRRGGETGARGVAAVPGEGCRTCAAGWRQRAPGPRRAAPGTRPCGAGAGRQLARWATGVPRQAAGRTGGGTVALSRRADPPGRSPACRQAGLRYGADRPPRRFSPRPAGAIAGAGAAAGWWRGADPGALRRVVSINENIFHSHMWVFLPAASSLLSVAAAGDIQQSLGESSSMTLPFTRAAWRPLCSAAVLGAALWAAGASAAERRFDLPAQPLAASLSRLAQQAQVQVLFDESLLRGLRAPALSGSYGVREALERLLVGSELELVEAGDGYVVRRRQVDAYSDNALQLDAQTIVGNGREVDASNVGRSTLTRRDIERQQADNIPSLLQTLPGVTMGGSPKPGGQTTNIWGLGDAEDVPYTLDGAQKSGFERYQQGTVFIEPEMIKRIEVEKGPHSVFTGNGGFGGTVHMETKDAPDLLREGRDVGAMLKYGYHSNDQQKIYSGAVFGRSEDRRVDALLYLNGRDGRDMKLADNLPLSPTDYPINPKRLPNSAQDEKTGLFKLNLHPTEEHDLGFTYLRSKSSRWTPFSASSYPTPPSQWTIDRYGYELGLTRLLAHRDTTDTTWTGKYNYHPLDNPWIDLQLSYSDARTEQLDRREDTAFYQLATGGKRMRTEYQDKVLELRNTSRFDTGALQHELTLGAALHKHKRDILMHMPGKTYETPRYNYGWLQPAFMPAGKQDTQSFYIQDAITYGSLTVTPSMRFDSVRNDGQANLAPIYDNPKLGHDYRAQTYSGWSPRLSVFWTATPNLAFFADYTETWRAPVIDEQYEVQNSSTIGGSSRDLDAERIHAIRGGSVINLPDLLVAGDSLQIRTTLFQNRIKDEIFRTRSVGCRQQSIDNGSIGGSCGDMLPLSNYRNLPGLTIKGFEIESFYDSQRLFGSLSYSWMTGKHDGAYSNPWGPNVWARDIPPPKWVAMLGLKVPEWDAKLGWQGEFVRKTDRLPSDRYSGGMGTGSGDIYWDHAANDSYDTHRLFAEWVPAKLGLKDTRIDFTVDNLFNRSYRQPLGGDLVYSQGRNAKISVTQFF

SEQ ID NO: 30936 - protein, 214 aa, Pseudomonas aeruginosa
GASAHRTDAPGVLGIPDGEHPADQVGARYVAPVAAVVGVVAVVAEHEVVAGGDGPLGHAQGVRLAQRLLRQVGLRHRALIDVEPAAIDPHAIAGYPGDALHIGDAALRREAEHHQVADLRVGEGVARGVGEDEVALLQGRFHRARRDIVQRHAEEPCARVETGGAERIRQVDGQHDRGEQAHGGPEASFHEGSLFRGGRPASPAPAVVIPGRGP

SEQ ID NO: 30937 - protein, 412 aa, Pseudomonas aeruginosa
TIVARRSPYVSRLPWNAGAERPPGPRSPIRFLWPIPAEEMSMSTAERAPILLTPGPLTTSYRTRRAMMVDWGSWDSDFNELTASVCQRLLKIVGGEGSHTCVPLQGSGTFAVEAAIGTLVPRDGKVLVLINGAYGKRLAKICEVLQRPFSTFETEENVPTTAADVERLLAADPAISHVALIHCETSTGILNPLEAIAKVVERHGKRLIVDAMSSFGAIGIDARKVPFDALIAASGKCLEGVPGMGFVFARSAALEASAGNCHSLAMDLQDQHAYMRKTGQWRFTPPTHVVAALHEALSQYEEEGGLPARQRRYASNCETLLGEMARLGFRSFLPAEIQAPIIVTFHAPRDPRYRFADFYQRVREKGFILYPGKLTQVETFRVGCIGHVDAAEMRQAVAAIGEALRELEVLEI

SEQ ID NO: 30938 - protein, 158 aa, Pseudomonas aeruginosa
TMLNTPAGMPLSAAAWRIASATHSAVAMCPPWALTTTGQPAARAAALSPPAVEKASGKLLAPNTATGPRPIRHWRRSGRGGVRPGCPRSMRAPWKSPRRRTSANSRNWLAVRVRSPWMRAAGSAVSRRTRATKSSPRASRREAIASRNPARRVADSCR

SEQ ID NO: 30939 - protein, 248 aa, Pseudomonas aeruginosa
RCGRSAANAWLSPVRGRAQSTERRNSTVSGRCGLPITWSGVPISWTRPLRKNATRSDTSRAKRISWVTRTMVMPSSASMRMVSTTSPTNCGSSAEVASSNSMYSGDIASARAIAMRCCWPPERRWGKTLSLSPRPTWVSCFSAIASASARLLPSTLRGASMTFSSTVRWGKAFHCWKTMPIFRRRRLRSVPRACTSMPSTRMLPRWIGSRPLMHISRVDLPEPEPPMIDSTSPLSTLRSTPLTTSNWP

SEQ ID NO: 30940 - protein, 185 aa, Pseudomonas aeruginosa
GWSVPVPGHRGRAGFRRSAGRPGRCRCKRRCARAGCRSAVARPATPPCAGRCASPGVRLRRVRRRAGPGRRRPVVGRHRSPALRRVGSPAAAGHRGGVPGVRRPGAPRDRRRVRRSARRDRRWVASGRTVPRRRSRRGRGFRPVRAGGSPPAHVRRGSVPAVRCCRYRSRAHRESPAACRVDGGR

SEQ ID NO: 30941 - protein, 178 aa, Pseudomonas aeruginosa
EAPRAMKALPACTGERPAPACRARARANKKPLQQAKNRIASNRPKRMLGRRSSDGGSNGQAWRRSWRSSVRHSQASSGTAAASSRAQGQDQCSDGPRANGSSRQRISAASSRVPGASMRAACSARVSGTQRRLQRRMPRQIGRLIRNTLRQPRPPMSAETRKPPSTWPTTKARPPMAP

SEQ ID NO: 30942 - protein, 217 aa, Pseudomonas aeruginosa
PTEASDARDHLHPASDARGDPPAGRATGHGTGLEFRLRRLPLCHGTGAGVPHQLLALRRLPGAAAALRLGRAAPVVGAPVAAPGADRGVGLRGLHRADRQGHRTRRLAGRGGADGRPVAAAGGLAGVGPAGAANAAGAVAGDRPGRRRGALGRACGAGAGAGAGLGLRPAAAGHASAGPGHPVAEALGRCAGIAGRGAVRADRRRAAGVRRPGAGGG

SEQ ID NO: 30943 - protein, 662 aa, Pseudomonas aeruginosa
HAAAAVRRIPVRARLAGAAAHLRRLRPVLAGPAPSFRTGWQRGAVPEPGADPAMGALDVRRAADTHAAGWSAAVAGRPRLAESRRASLAGVALPAGQGLQARRAERRTRRRRRPAEQELRGAAAYPPLAGAHAATAVQLGLGPAGMPGQRGQGDVFATADQGIRLRQLTQFGTQGEVSRQGVCEALPASPSWPHAASRVALVDGGMAGDGAFHQGQFAAAEAGAFAGGVVVGQAAGLPFVDGERRAVEAIAEGLAELHVGHQAEAAGQAFAGDLADPTAFAQAHGFQALLAEGGEHVAVGAVATGEQAGGLPQLAGPAREAYGEGGQGSRRRLFGDAQQARPALAGAGGAGQQQRAGASHHQALAGQWQAALGQRLQAAGAGDAGEGPAGKRQQQFAGAGAEDQASVADLPATLRVFQQQAPAGTAGDHPGRREVLDIGLPGQALAHLMGTRRQAGTRAVAPDLSAGGRVVVDQGDARAARRGGQRCGQAGGAGTDDQQVVVGAHAWVSTRMPDWQTVWQARRRRPSINTRHSWHAPMPQNGARRPPPTALREQPSPPRARAAATLVPTATRSGRRSMNSSIMAGHSRSWRGSVAADKAWHPAAAFRRTTGRRAGARCPARWSRPGPRGRPPATGPAAPGARQAAAGRPEWQRGSRSRHGSH

SEQ ID NO: 30944 - protein, 107 aa, Pseudomonas aeruginosa
LRRAIDAGAGRLVRAASAPRWARRGCRRPAPSGRRRGLAARPVPSHAGARRRASRRRRRRPAGPGACARLRRVRRRRRPARGCRNCGTRSLPADPPPRCARPGSSSR

SEQ ID NO: 30945 - protein, 744 aa, Pseudomonas aeruginosa
KISLLIIRSLMYFGASAMAKPSFFSSDLVQVLLCPRLHELQFAVKALLAGGLALYLAFGLELEQPQWALMTVFVVSQPYSGMVLAKGMFRLIGTCAGALVSIGMVALYGQASLPFLLLMALWLAFCTAGASLMHNHASYGFVLAGYTAAIVALPASADPATVFDQAVARCSEIGLGILCAALVSVLLWPRRLERQLANQGKAAREAGLQAAAAELRGADERGELLAALGRISAADAQRDHAWFEGALGRARSQALRVLGLDLLGLLRAARKVARERRLLDPASAHALQPWLEELEALLREGRQAEFEACRQRLRLALDAAHGQLHLCLVCLERLLGEARAAGRSVEALVYGAPTRQAPGAIAWHRDIERGVLFGLRSALAFLCVAAFWLASAWPSGLGAVSITGVVLSLFASRDNPAQAGLNFLRGILLSIPLAGFVALFYLPGVDGFPLLCLGLGVPLFFAALCVNRASLAGIASPFCIFFVKNVAPSNSMSYDLAHFLNNALSTVLGVAFAVLVFNLVSLLPGERHYRRMLHATLGDLARLTLRSPAQAEAWFGGRTADRLIRLAQRYDRLPEGRRQPWSDGLMGLDFGDEAALPAAVPGGGPGVPGAGPATVTCGACAWRCWAMARGPSVNTPSTRRPRACSRPWPPARWPAANAASWPAPRWCSCRPPGGSGAAAMLRPGRRCARTRSPEPGASSAVAGHIDRASPEPLSCAPCDRCPARGETGKLVRSVGTRPALPPQR

SEQ ID NO: 30946 - protein, 465 aa, Pseudomonas aeruginosa
VWSSTRSRPGSRRRKEWNSDAGAMRGDASPMTQARCPALLIAAPASGQGKTTVTAALARLHARQGRRVRVFKCGPDFLDPMILARASGAPVYQLDLWMVGEAEARRLLARAAGEADLILIEGVMGLFDGNPSAADLARRFGVPVLGVINGAAMAQTFGALAYGLAHFQPDLPFSGVLGNRVGSQRHSDILRDCLPPGMRWFGGLPRSAEFELPSRHLGLVQAEELADLDVRLDAAADALRASAETDLPEPVTFEVPAPAPLQRSLEGVRIGVARDASFAFLYQANLDLLRELGAELAFFSPLQDQALPAVDSLYLPGGYPELHLGRLQGNRAMAEAIRAHHAAGKPLLAECGGMLYLLDCLEDADGERGELLGLLPGRARLQKRLTALALQEVELPEGRLRGHTFHHSTLDCAVEPLARGVCPNGRNTAEAVFRLGRLTASYIHFYLPSNPQAAAALLAPARDAD

SEQ ID NO: 30947 - protein, 530 aa, Pseudomonas aeruginosa
HVRFFPRLQRHGTRRRLPGHRRAPRHAPLQRRQRGAGAARAAAGGRAPGAQRRPDATLALHPYHRVGVAPGHPRAGRGGTRTHRRSPRRALRRVHAAQGRGRAGLRRTAGRRSDGRPRAPCVRSPDPAADGPGVARLRDPQPLAGQSRRGPGDGLGIAVRSGRAGRAARPAARQRSGGGALPGPGGGVLPGADAGAGGLERTASAGRAGLPEPLGRASMSALLGILGVALDARFGEPQGWHPLVAFGRLADRLERRFNRSRLAGEADPGVGWRSHGVTAWVLAVLPLTLLAWALAELPYLGWLVQALALYAALGLRSLGEHAEPVALALRAGDLDEARRRVGYLVSRDTRELDQAGVARAATESVLENGSDAVYAALFWFAVAGAPGVVLYRLSNTLDAMWGYRNARFERFGWAAAKIDDILNYLPARLVALTYALLGGTRQALRCWREQAPQWDSPNAGPVMAAGAGALGVSLGGAAIYHGELHQRPLLGSGPQPQGRDIYRALALVRQGVLFWLLVLAGLWAMGWLHA

SEQ ID NO: 30948 - protein, 327 aa, Pseudomonas aeruginosa
TRRAVARGGAPLRHSAGGLAGPVHRHRALAVSAAGDPRAGLDPPAGERRRPGSRCLPLLRRRTGIAAGRQPGGDPGPAKVAAGRAGRRPVAVLCRARPRLAPGRAPGAGDRRGRGRALSRQPRRAAGGQPEQPHRAGLRARRAAGLACPPATSRRLAAGRRGVHGLHPAVEPGGLYQPTRIDRAALVRQVLRPGRCAARLRPRRTAAVAGAGRAARPVDGQWPGAPCGPECLARPPATAPAARAPAGRQPAPGGTAAPPRLAAGGRQRAVPAPGRSTLRGVARLPGAARHPHPPVRAAGQPAPRPARRRGRLGPAGCRAARLQGACS

SEQ ID NO: 30949 - protein, 89 aa, Pseudomonas aeruginosa
SWSPISTAAGSSPTWSAPWNCSPTRSGSGSRASSSIASAATSPCCNPASTGWRHAPASRCSACCPMSATCTWRRRTPSTRARRPRSGRA

SEQ ID NO: 30950 - protein, 280 aa, Pseudomonas aeruginosa
AWRMRRCRATRSMPGSPVARPWRGRRWCSTMVARMVPVASTGTSWAPTCTACSNPPRPVRRCCAGPACARSRRWTTRPCANATSSGSPTWSSATWIPGDCSPSAENPMRDLILGGARSGKSRLAERLAAESGLAVSYIATAQAGDGEMGRRIAEHRARRPAHWRTLEEPLALAATLRSEAEAGRCLLVDCLTLWLTNLLLCDDPQRLDGEREALLECLGELPGRIILVSNETGLGVVPLGELSRRYVDEAGWLHQAIAERCERVTFTVAGLPMPLKGEPL

SEQ ID NO: 30951 - protein, 145 aa, Pseudomonas aeruginosa
SPRASRPIRRRSPARCCATSSAAARRSACWRANSAPAWRWSTWAPRSPWKPCPACVTCAWRRAPRTSSRPRRWAPNSACWRSRPGAKACAAPSRPAASCSSAARWASAIPPRRRPWPARCWMRRRARWSGREPGWTPAAWRTRPR

SEQ ID NO: 30952 - protein, 514 aa, Pseudomonas aeruginosa
  UNSURE (476): Identity of amino acid at the above locations are unknown.
TRPAATGCCSPTAVPSRAIAMCSKPWRRNRCSTSACAWARVAARRWRCRCCARPARCTRGWRPSPKRRSRTARHEPAPGPPAAWRNRVRRRFPRQPRRRLDRAWLGADAHGGGRRTLGPAGQLAIATLPRLRRGTGAAPGDRAGTGKRSARTAFRRLGGALGGRPDGRPQRGARPLLGRSLRLYPAGRRAAVRVRGAGAGRPATPAPASRRPSCAAGDPWRRHTPVARLRPWLAARALAAGGRRSWRTVRPARRRGRRSLARMPGRGIAMREALRSLLVALQFLTRLPVRLSAMPTPEQFGRAVLCYPLVGVLIGVVLYAAALSLDGTPQLLQAALLLSLWVALSGALHLDGLADMADAWVGGLGDRERTLAIMKDPRSGPVAVVVLVLVLLLKFSSLAALLGQGEAGLLPLAPWLARSSLPLLFLTTPYARPGGLGQAIAEHLPARSLPWVLGVSFGLALAFGLAGLLALLVTLXLFAWLRSRFLARLGGTTGDTAGALVELTECAVLVALAL

SEQ ID NO: 30953 - protein, 403 aa, Pseudomonas aeruginosa
MERPMPRAAFWILLSGALILALSLGVRHGFGLFLAPMSADFGWGREVFAFAIALQNLVWGLAQPFTGALADRYGAARAVLVGGLLYALGLVLMGLSQSASGLSLSAGLLIGLGLSGTSFSVILGAVGRAVPAEQRSMAMGISSAAGSFGQFAMLPGTLALIGWLGWSSALLALGLLVALIVPLAGLMKDRPLPPQGHEQSLGEALREACAHSGFWLLALGFFVCGFQVVFIGVHLPAYLVDQHLPAHVGTTVLALVGLFNVFGTYIAGWLGGRWSKPRLLTALYLVRGVVIVLFLWLPLSVYSAYAFGVAMGLLWLSTVPLTNGTVATLFGVRNLSMLGGIVFLFHQLGAFLGGWLGGVVYDRTGSYDLVWQLSILLSLLAALLNWPVRERPVARLQVAGGAA

SEQ ID NO: 30954 - protein, 335 aa, Pseudomonas aeruginosa
GTYREGPGVAPVQVFADGVEAQGLAERRYAAVAHLDLLQAAPAGPDGAQVARPLVVELVGDGGIHRFRQGDVQLGIVLAVQAQGTRSVLHFGVAAQVVLDLGVVGQAPGGVVGQVDHHADVVADGGVVALDVDLGIAVAAEQAIGGQGVLQLAVDAVEGRTEADGNLVVDLPGDGRLHGDHLHLAIGAVGAAHEAVFVIVDDAVGHVDAQAESEIFVDRRGEVAERYGGQRYRVALVAALGGAVGLADVVLGLDDGQTAADFGAFQLGQAGRVAVDGAGIERGRGAAGVGGAGAAGALFVDGDAVGEGVGGDSANGQCERGFKPYCFHCWSNSCV

SEQ ID NO: 30955 - protein, 143 aa, Pseudomonas aeruginosa
TRAGDRAAGIPGATREPGRGGRAGRAVAVARLPPATRRWPCCSAGSPSVPGAARRGRHAGWPGRGPGWRAPGPAPGTGPRAAGGVRWRSGTGRGHGGRRGRSPAPTGRPQRPAAALRRRGCGRTGSPGSGVSRAGKDRWRKYP

SEQ ID NO: 30956 - protein, 527 aa, Pseudomonas aeruginosa
TGASLLRLCWAAFSAPAQAVEEVADDGFHFIGRLPLVACIAKTHRGLGKEAVELADQGFPAVVLEFATGRQFVHQAPDVAQRVARVDAFPSLPADDRDHLLQRQLPLAARHHAVDEGLGQCGGLRPLVDMRRHPVQVLGDRPYLAFVAFGEQFLLAAEVVVERALGHARLAGDGVDGDSAIAMFDEGGEGAFQQRLAGRLGIFLLPALDIHTAAFLHTVGMFMLARLAIRRALRPSRLLEPARQRRERMSTAVEIACRDGVRLAGDHFPAVGDAQGSIVVACALGVRRAFYQRFAVLAAASGYEVLLFSYRGSEGDDPAVASYRLADWGREDIDAALAWCRARAPELPRYFVGHSIGAQLLGLAGQASGLSGAAFVAGSFPYWRRWRGRQRWQMFGLFCVAVPLLTGLLRRFPSRFFGLGSLDMPSHFMRDWARWVRQPDYLLAPRFGLQRQGYEALDIPVASFLFEDDDYVPWAAAEKLHQVYAAAHLELRRKGRAEGAVGHFGLFRNEALQKELLDYFRKLPDAA

SEQ ID NO: 30957 - protein, 571 aa, Pseudomonas aeruginosa
LGGIRQRMATGHALAHGSGKIPFEVGEMRAGNVVLLIDAGTVGRVFEGETAVEDQQVGFAEAGCQLLRGQQLGGRHRGLLGSGSKAGGGWVDHAPWTASRHPGVARRGGEMAKGKGWLQARKIPTRSSASPGSGGFVQTCRIGSFRDTRSCVLSLGTLVRLAWPDACAGLFFASAFSGNRQTADPIVFQAAEVELVAHRLRRGDHAQVVAAGVVQAADDPALFVDGDDQPVGGRLGQEHARQLGQLRLQPGMPVEEVGVGLARGRQGHPEGTLAVALEVVRQARQVVDEHLVLASLLAFQPVAGDAIAVGLVDQYEVLVCRECHAIGEVQVLEQHLGLAGGRVVAQQAAVRSGLEQVEDVVGLVELAGSVAEVDAAVAGDVEVVGEGEGDTVGLGGEDFHLALRIDAQQAFPGVGEDQVAGGIEVHAQRAAAGVDEGLDLAAGVQAYHAAVGETGIDAALAVHGGVLGAVQLALAKQLGLHQGVVGFEDPGHLRSGRSIPGERVDRAGLQGQVKSRASQQEDDYSAELLHAVPLFGLSDKGRSMDIRYAHRQARCRAECSHGARLYIMRRT

SEQ ID NO: 30958 - protein, 93 aa, Pseudomonas aeruginosa
SPRLRACRRSEWPEALPEPLPPEVTPLLKSLRAIGQREAETLGMAPELMLRKKVLEALLKSGYPDGPYELPDSLRGWRRERMGQALLDALESA

SEQ ID NO: 30959 - protein, 202 aa, Pseudomonas aeruginosa
AARKIQIVPVRHDGRGGGGGGGGASGRARGGHAVAQQPGAGEIDQQAERGDQHRLLVVDRAGVEQAFDRLVEHQPGHQQKQQGAGVAAEHLDLPRTEAEARVVGIAPRGAVGEYRKTQGQGMGAHVPAVGEQGHGVEQPAAGDFRDHHAGGEQYRPARVALGQRVALVEPMGMAQGLGSRGAGHLLLSCRDVENILYPSILP

SEQ ID NO: 30960 - protein, 154 aa, Pseudomonas aeruginosa
TIAPFHQPPMPWPPKSNPSGNARPSPNSTRTSGSRCATVAACAACRSSRTRTTAASTTRVSPASCSTCKAAAAPTTPSASVSSPTVSSSPRRRPTSSSGCRRPAAIAWLPKARTCRSGTTWSAATRSGSTRNAFPSPGACSARPRWPRTTGRTT

SEQ ID NO: 30961 - protein, 539 aa, Pseudomonas aeruginosa
YVLSFAYLQGTSVSDGSGEARCCSGSTARGAPPEDARMDERFRGSVSHAYQAFHGELLRFLRKHLGSSADAADLAQDTFAQWLKWPGRQSVEQPRAFLFQIARNLLRDHWRRQQSRGQDLDRPAANDEPAALEGEAAGPGERFEQQQRLSHLAAALAELPPRRREAFVLHKFDGLSQVEVAERMGISPEHGGKAHRQRLAALQAAAWPGRRRMKPLERLEPLFADETEEDIDHRAAYWFSRRRSGHFSAACRAELEDWLRADPRHREALEGMERLWREFDGLPRPALDDIPEPVPAWRLPRALAAAFFVFCALLVATLFWRDQSLGPNLAYGTAPGEQREVVLADGSKLFLDVDTQVQVRYAERTRDVLLKKGEVFFVVSHDPARPFRVGSGDSRVTVLGTQFSVRRNAQALAVAVKQGRVALQPSLEKDAEHVLLAGDSARLDLAEQRLELGHVAPEQVASWRDGQLVFRDKPLGELVEELSRYRAAPIRLGDPRLAGKRVSGTVRIARPDDFLLALPALLPVRVQPQAGGEVLILAR

SEQ ID NO: 30962 - protein, 747 aa, Pseudomonas aeruginosa
TASMIAASRPMAGQKRRFTKVPFFVAEGRRRRPPRWSYQAEDLEQEGVFQRHVLQPLVAAAHAAVAGAEVGLEQQQVGVGPGRPQFRHPLGGFPVLHAAVVVAGDHQQVRVVLGPDVLVGRVGGDPRMHLGLLRVAPLIVFGDGQRQVRIEHAVQHVDERHLGDGRAEQLRALVEHRADQQPAGAAAADGEALGTAVALGEQVLGAGDEVVEAVLLVFQLAGPVPGFAQFAAATDMGDGEDEAAFEQAQAGVGEPGIEAMPVGAVAIEIERRGAPGGDAVEDFLARHQADRHLRAVAAAGPDAPAGVGVGVEGAFHRGLLEDGLRAIGEVQLAYLRRTIQGLVAQSHAGAVEFQAVLHVEAVGGVRQLHAVGRQALRLHLDHRQAAVAQAEDHRLGVQADIFQGPLRVVGHAQLPVLASRPRLLGLVEGEVDPRLVAADQPQAPAVEATVVGVVLVAFLARRQATERSLRLVGVEHPGLAGGLAVEQEDQLAFRAGAVAVQEEAPVAFLEHQLGAGLAQAVAIELVRAVGVVQFAEEQRAVVVGPGQAAVAVVEGQGLHRAAGEVLDEQAVDLVAAGVQAVGQQALVGADAEGAEGEEAAVGQLVGIEQQLLGAFVDLQAAVRRTRAAVVARVFVAGGGALVVQPRTPRIGQRQVGLADASPDLLEQGLAQPGLVGQFAIQVGVLGLQVVEHLRGVALLQPGVGVASGVAAGDGGLRMGHRESSSIRPCARPGNLNKTGGAAPAIGG

SEQ ID NO: 30963 - protein, 279 aa, Pseudomonas aeruginosa
RISQERCVQCPDQRRRLAVHLLLQQTRLHYPPCAIRPGAVEGCRPDRGLPGGNHAGRCGHGDRHRAAHRQRELDLAAERRVGPLVGRRGVGQGAGLNRRRERGERMFRSYLRLLLFTLGLLLGVQVPGFIDDYAKRVDAHRLEAAQNIQGFQQTAGQFFNGSLEELVRHYRSNSDPVFQRDGENLDRLMRRARMLDAEWQAMQGPWYARAWHMLRAPNHELLMETYASYSYQVLLKPEVIAWGLGCALLVAWIAELIVYSLASLFGFGEDRRTRERHWS

SEQ ID NO: 30964 - protein, 306 aa, Pseudomonas aeruginosa
GATQAAASSRNALITRRPRRFSRQPIRWRLVSSGPTSGTARTRGSLPTSREDTTPTPSSAATASVTASRLSSSSSTRGCTPCSAQARSKVRRVIEPGSRSTMICWSSSSSGTPSLRSHQGCWRGNRGADARIHQLLQEQPGTRLDLGQHGDVDVCAEQPREVLLGVAQTQVDGDSRIARAQPGEHRHHQVRAVGGDFEAAGDQLSIGVEQGLGFFLQGEQGARDRHQARALLGQFDAPGGAPEQGDLVVLLECLDVSGHRRLADAQALGGAGETAFAGDGVEGAELEEIHGIGLAYGWHRNKQFER

SEQ ID NO: 30965 - protein, 143 aa, Pseudomonas aeruginosa
SPPPASAWRASPGWASSSPAAPPWKPAPATATPWPWTCRTSTPICARPGSGASPRRPMWSPPCTKRSASTKRRAACRRASGATRAIAKRCSARWPGSVSAASCRRKSRRRSSLPSTRRAIRATASPTSTNACGRRASSSIRAS

SEQ ID NO: 30966 - protein, 300 aa, Pseudomonas aeruginosa
  UNSURE (115),(198),(225),(228),(232),(235): Identity of amino acid at the above locations are unknown.
VDNGAGRIAGNRGVVIDARQVDNRAGEIASQGVATLNLTEQLDNRGGKIVGDSGLGITAPRVLNQDKGVLASRDGLRLSGTELFNGNAGLLSSQRHIEVTLDGVLDNQGKGALLXDGTLTVSAGRIHNQDATLSSAGALILSSQEAVDNRGGKLVTDSSLRLTIASLDNSRSGIICANAAAEIHTGVLNNSQKGDLGXNERLGPIATDVDNNQKCLITCPGVIDXNIXGTHXHGXRPAGHYCRILLRPELGNPVHGAPSPNLHPWNPWSGAHSGWWYTTGGENSPQTSRQNPPTPGGNNQ

SEQ ID NO: 30967 - protein, 162 aa, Pseudomonas aeruginosa
PPPDSRRPGRRRCRRRRWKRPAGSCWHRTPPPGRDRFATGAGRGAAGYARVVLDRCARRGSRHAAGLRRTAATGWRYVFVRPGCVRRAARSRDGPGRRSRRPGRRGARRSPRGIRRGALRTVAGSVDRRVRRRGRRRRPPPRWPGRRRRAALRRCRRRGCAG

SEQ ID NO: 30968 - protein, 529 aa, Pseudomonas aeruginosa
GCRRRCERRRRSCDRGCWAWGLPGDGGRNALPLALAGRSPGSEAARAGRRLQADVRQRRPAGQGLGHDPLDVLAIGAAQGQARWTGEGAAATGELLAELDALHQVGTGVEMEDRHQPLVDRHRLGEAPGPGQAEDGLAFLREHVGHSRDPALGTHRHAFQDHVVEPGEEDEALAHLVAYVDEAAGVAGAVLEADDVLAVGQGNQDVRGDVVPVDRRVVVDHHRQVGAAGHAAEMLGGLVRLGGIDQRRHHHDAVDADPLHRLGHLRRAGAGELGDPADHRHAAAGGILGDLRDGHLLLDGQRGVLADAAAYHQPGHAVAHQVGDDRVGFLQVHREIGVELGGDRGEYAAPVDVLAHGFSFFRISYTNSIGPLRSESQGDGSVRRRGRSGTRRIGFRPAAACGRAGWSAVAAGPGVGQPIALRPGIVRGEQVLVDAGDPGPPGQAREDRRTAAEFGQRLDVAVEFRTDDGAPDEAFADPQLAFRLEHRHPRRAAGAAGRAVDLAGADDHRVARAEDTVAALRRRGQLAEG

SEQ ID NO: 30969 - protein, 258 aa, Pseudomonas aeruginosa
SRSLLPSPFQPGAESRDHPAHEVIDEPRDAEHEEWFLDARDDGLRGAQQFDDADPEHQRGVLHHRQGQVDPTGEGHPGGHRQDDVEQVLAIAQAQRTRGPAHARRYREDAAADHLGAVGGGVHAEHQAGHGEGAPVEAEDALEGIEQDELDQQRHAAEYVEQRRQRQAGAWQQGAEQAEDDTQQGADQHRHGGDGEGGPGALQEEQQVVGGEAGGEHGIPLSNGTGASPAGGRPAPAAWPWRSRGRRPGRSIRRCGRS

SEQ ID NO: 30970 - protein, 482 aa, Pseudomonas aeruginosa
TPSASGRCSRTSAVLAQPGGQPGGGPPADGGLDAAGEAGEAHLAADQSGGVVGILGGVGHQGARARRHQRFVEHAPAGVGDQPRAERLQRRQVPGRFGLGDDLPAAGDHQRYLRVSAAAVAERGELGEFAGGEVRVAQRHQVDPRLAGAVQLAPGVAQALASDPQGPPRRAAAEGAGQVRGFRGDADDVEHRHRGTGAQRRAEGLERVVVRLPLPQAVDRRDLPVAEQAAEVAEGRVEGIVDAAEVFHFDQYPRLALLVEVAAGQRRATGEGAADIHEVGVLVGACAEHAVGEEHRVGLGPDDLFAGPRAVVEQVGRAGEAGLRAHVEIGLGQGRGWLAEGGGYALFAPTALVHGDGVEGGRYPYPGTEVAQGFGEAQAGRAGVDASVDVRALDVDQPLRALQRRHAQDDAHRQACGFAVFAGEQGLVEGVQSWAGIGRQRFGGSGLQRRRGIAVEFQASVGQARPGIGGEFVEALAETGDG

SEQ ID NO: 30971 - protein, 137 aa, Pseudomonas aeruginosa
RHCRPVPARDRRRPAGPGRGRTRSRSSRRRTGSPATGRSGCSAGAAATAAATARPGGVPGAARCATARPAAAPPPPAAGRRARTSAAMGREPTAAAGRGSARRAAGCPARRCGRHARRGFPVPSGGCKGECRGRSAG

SEQ ID NO: 30972 - protein, 389 aa, Pseudomonas aeruginosa
TATISSSSVSLAPREWARASRATLTMEKSIIGNSCPASRMQSPARPSRDDETVLGMGGVLVRKGVGWQHALLANPVPVLAYPGIGATRLPFGGLRHAPRRPCQPRCGKPRAAVPRRTAGGLPAPPAGKHRAAAGRHFPPRPPTHAGPASRGGGAARRGRRDLVHLAGAGPRGTRFGAGDRSHRPGPAVQRDGNPPPVQPRRAGRADLGAAGGLREALGRHPGHPRCPRPVAGHGAERPFRHPRLQPRLLPAGGHRPGGDPRGRPQLHLPGADPRALALLHGQPRGGVAADGRLLPRGNGRAHGRSAVGAAVAALPGGFGGVPRDLAAQRGDGYRKPAQALPSCALRRIRTAADQLVVGAEERRSPAGLRPPRRPRPRLPGATVSRRPVP

SEQ ID NO: 30973 - protein, 311 aa, Pseudomonas aeruginosa
PRLEPDRRRRAMRATTCTPRAMPGATRLLAVQLGMVLAWSSGFVGYRYAMEQAPVFLTSFWRFAVCLALLLPFAWAGLRRLSARQWRRQALIGALAYAGYIAPIAKAIELGVSPGVAALMADLLPLLVALLALVLPGQRTRPGQWPGIALGVAGVLWAGHAALALGRAPGWAYGLPLLGMLALALATLLQKRWDDAPGSLAVVLFVQIGAALPAFAGLALAEGSMRPPLSGGFLFGLAWLVLLPTFGGYGLYWLGLRHLSAQGGSAALYLSPALTLLWAHWMFAEPLTPMLLGGLLLSLAGLGWLNRAERR

SEQ ID NO: 30974 - protein, 416 aa, Pseudomonas aeruginosa
TVRSWPGTPGAGEEALRQIRRGIQRRRFAEQLGGEQARAARRGGHAQALVADRQPQARLRRVLAKQRQAVRSGSAEAGPGTDRIEAGEPRQVVQGTPQHARQHRAFHLRVERVELPRGAEEDLPGGARLGVEGYRGTAAGVGAADIAEFHQLMAEGAGIAVGDQQVAFLRADRQLRAQLAGMDAVGQHQRLGAQPAAVGQAQAAAVHFADFGVQSTQARAGSFEQPARRVGRVEDAVARHLQGAGEAWPQDRFQVTQARGVEHLAGDAGGQQGLALALGFGEFGGVGGQPEGAAIAVRAVFRQIRRPGAPGLDRVVAEGQFGRVVVHRHQVPHAHRGGTAAAAVQHQYVEAATRQFMGAGAADDAGADHDDLGVHRRMPQANGSSSASSRVASALTWARPRMVGTIRPPGWPSSHS

SEQ ID NO: 30975 - protein, 175 aa, Pseudomonas aeruginosa
RQRQGQEQLGLRHGRAGPGPWHEGRRCAVHQGRRQHRRGSLLPALPRGSQLPRDGRGLHLGDPGPPARHRQGRGSLEGRRAIAGRPGRGPGGAGRIEHRPQARLPGTGQGPRRHPGAPGHAACGGDRPRRAAGDGRGRRHGDRDESGQARVQGRDQGAERSGILMPAPCAETLRP

SEQ ID NO: 30976 - protein, 246 aa, Pseudomonas aeruginosa
RLPISISTCLPTRRPPPRCWRPRETPTDMSDSSHAFSATERAAVYRAIAERRDMRHFSGGSVAPELLARLLEAAHQAPSVGLMQPWRFIRITESALRRAIHGLVEEERGRTAEALGERSDEFMRLKVEGVLDCAELLVAALMDDRERHVFGRRTLPQMDLASLACAIHNLWLASRAEGLGMGWVSLFDPAALGELLGLPPGSEAVAVLCLGPVAEFYPAPMLALEGWSEPRPLAELVYQNRWGERA

SEQ ID NO: 30977 - protein, 397 aa, Pseudomonas aeruginosa
WPPAPVRWACPWAARRSTTASCTSGRSSAAARSRRAATSIGPWRWYARACCSGCWCWPDSGPWGGCMLEHGGRLREAARRYDIPLADWLDLSTGIAPWPFPLPAIPEQAWTRLPESDDGLEAAACLYYGAERVLPLAGSQAAIQALPRLRRGGRVGVLSPCYAEHAHAWRQAGHLVREIGEAEVEPYLDSLDVLLVVNPNNPTGRVFEPAELLAWHARLQRRGGWLLVDEAFMDCTPQSSLAACINRPGLIVLRSFGKFFGLAGARLGFALGERPLLQALAEQLGPWTVNGPVRHVAQNALRDRQQQRQQRERLLAASQRLEELLRRHGWPPAGGSALFQRLVDPRCAALHDYLARRGILTRQFEQPASLRLGLPADEAAWARLDAALLGFKEPAHE

SEQ ID NO: 30978 - protein, 365 aa, Pseudomonas aeruginosa
SRADPDGPGHHLGRRQEHPGDRAVPLAGPARRRGGAVQAAEHGAEQRGHRRRRRDRPRPGGPGPGLPAGAAHRHEPGAAQAEHRHRRPGDHPWPRGDQHGRRRLPRLQARGDGSGAGFPWAARRRLPGGDGGGRRLAGGDQPARQRHRQHGLRRSGGLSGDPGRRYRPRRGLRPPGRHPGTALRLGAGAGQGLRHQSLPRRHRPAATRPRLAGGTHRQAGARRAALCQRPAPGGGGRHRHAPGGQGRAAPEGGGAGAAEDQQPHRFRSAAPAPPGRVELRRPRPGAAVGGPDRPARLEERARRPRGAARARLGRGDPPSPALRRSPAGDLRRPADARRAPARSARPGRRGRQQRWPRPAGVGNDP

SEQ ID NO: 30979 - protein, 322 aa, Pseudomonas aeruginosa
KENRYESAMVARHLPRGGPADAPARGRTPGPVDQAARLAGPPGASGDRPGGVAGARTTEPGEDLGDGLRRRPRGSRRGHLGLSAGGHRRDAAQLRPRRRGDQRAGARTRRRPGGGRPGHRVPPGSLARRASPAPGGGHRELRRGPGDGRRTVPAGARGRARKRAPRRAGRQPAVHRRRDGHRQYHRGGGHGLRAAGCAGERAGRAGNRAGRQRRGAQGRGDRACPGPARRPSRRPLRNPPPSRWPGDRRAGRRLPGLRAERHGRPGRRLHLQRRGALRGAPEPGLPRLAAVRPQRCRAGPSPCARSPGGATAARPRPAPGRG

SEQ ID NO: 30980 - protein, 226 aa, Pseudomonas aeruginosa
RRGAGGAAAAPGLRAARGDGDLRRSGGLGPPGMSLRLDLLRHGETESGGGFRGSLDDALTARGWAQMRTAVEGGRWDLLVSSPLQRCRAFAEELAQRQGIELELENDLRELHFGAWEGRSAAALMDGHSEALGRFWADPYAFTPPGGEPLSEFEARVLAAQRRLRQRHAGRRVLLVTHGGVIRLLLACARGLPRERLLQVDVGHGALFGLRAGEGDDRWHECREGE

SEQ ID NO: 30981 - protein, 268 aa, Pseudomonas aeruginosa
HGDEGLVESLPGKLDEPRRDLRRQALGDQQGVVEAVADPRRQLGRGQPQRHPVDETHQAAEQGHADHPAQFVGHVFDGGRHSGTLFVHVEHHRGGGGGHRAAEADAEQHQAGQLRSGDGLVGQGQAEQSGAAEQQGGAHHPVLAPARHQPAGQRPDHQRGQRDRQDEQAGLQRRQVLHQLQVLAEHQFHADQRHGRHQGHRDAAGEAPVAEQREVDHRFAGAALAADEQVQAEHAAERGEDDQPEVRGACAEFLDRIHHPDQAEHHLQ

SEQ ID NO: 30982 - protein, 223 aa, Pseudomonas aeruginosa
AEGVPWAPRLAAAGRDGRQRQQQSDDHHRDVDEEHRAPPEELQQHAADHRPQRRAGRGDGGPDADGQGAFAFVLEDMADDRQGRRHHQCRAHRQPGAGGDQRRGAGGEGGAQRGQAEQRQAGEEQPLVAKAVAEQAGAGQQAGDHQRIGVDDPEFLRGRRAEVVGQARQGRVEHGHVDDDEEQGAGDDGQDQPAVLPEHGITSVANGSSLAVDNGNCAPRAGA

SEQ ID NO: 30983 - protein, 558 aa, Pseudomonas aeruginosa
GPGIGQRGVAGEHQVVVAGGAHQIALLARGEGNAQGQQVPLGAELEQHQGAAAHARLVLQQVDGEPGHAPGEVAHGLALGHQQDLAAEQVEGLDAGGAFVEGGDPRVADDLLHAVFADIAVAAEHLHAEVGAFQAEFGQAALEDRREEAELVVPAFVFGVVVAEDALDHPVGVLGGQVDQRPAAFGDGFLGQQHAPHVTVVHQAVGDLVGFLGPGERAHGAAFAGVGEGALVGQLGGGHALDGGADAGAVHEGEHAFQALVRRSDEEAGGAVEVHHAGGRGLDPHLLLQRAATHAVARAERAAFAGKELGHDEQGNAAGALRCVRQAGEDDVDDVLGQVVFAGRDEYLRPADGVATVGVGLGAGLHLAEIGAALRLGEAHGAAPAALGERNQVGLLLFLGAVLHQGVHRAEGEAGIHGERPVGGAHHLLLERAEAHRQALATVLHRVREALPAAGDIGLVGFLVALRRPYFAVLQVAAFLVAAVVERGDHFLAELRAFAEDRIDHVRRGFGSVDQVAVMLGEIEDFVEQEARVAQRGFVNGHGYLGDGWRAPGAPGRR

SEQ ID NO: 30984 - protein, 317 aa, Pseudomonas aeruginosa
CQPGAAMPGMAHTAVPRARYRVHARRYLLSRGRSGAGGRWPAGVADRSAADPGLEPLRRAARRRAGGEGAACLQRRPRGVPAPHRQPAGAAVRYAVGRRLSRHGPFDGLLEAGEGGAGHRPAQGRDPFRLVATAAHRDADALRRRRRPAPRPGLPGPGCAAERGETRLAAGGRRRTGRQPLPRERSARGLPRGQAGLAAASAATGGAPRTLRLARGAGTPAQPAAQPRAARTHPVAAGAPAAEEQDRPGGDRGHASAHRAPGRRLPHRTDRPGCAPAAGANGPRRCPSRCRRRSPRCSRACAPSASAKRRPWAWRPN

SEQ ID NO: 30985 - protein, 311 aa, Pseudomonas aeruginosa
PMRLLILERDHALYAALLMAADPSLKVVAGDDPLQLIDAASECSIWLGQPDLVAQMLRQGVHPVWVQSTWAGITPLLAADLPKDYSLTRAVGIFGQVMSEYLLTYMLAHERQFLGRLASQVGSQWDSRTPGGLRGRQVVIVGTGEIGQAVAHTLSGFGMDLTGVAKNPRSLVPFNRMGSLDDLGRLVETADYLINLLPDTPDTHDIYDRALFARLKPTALFINAGRGVAVVDADLVAALENNQLAGAVIDVCREEPLPANHLFWHTPRLLLTGHTAAPTLPGAMVELFRDNLARFWAGTAMRGEVDFARGY

SEQ ID NO: 30986 - protein, 186 aa, Pseudomonas aeruginosa
ASTARPRARAWELMCQPSASRAMELNSQPPAISATIMQAVSNTAQRVLRSASGLPWSNRWEWRRGWVVGVPGICYCPVETSKIYYTPVYYLEERAVAHTIHGKKKLLARVRRIAGQTRALEQALEEGSECAAVLQQIAAIRGAVNGLMNEVLEGHIREHLGAEQASAEQRREDLELVVTALRSYLK

SEQ ID NO: 30987 - protein, 588 aa, Pseudomonas aeruginosa
KYFSFAYVGFSPCCVFSAVRRRCRRHPAVTWGEFQHDLAFHPRRLAPAVFRRRARRRVVGRRRQRCRTTLRPAGAAAGRLAVAPGAAGAGPGAVRRVAPAGPARSGAERQLRGARGAGAVAGRFRAGAGGGGRRLRGAPAPGRCLQRQRAATGRADHRRQRSRSGRQQRRPFDPDPAGYRTPAGGQHPQPAADPARSDHGRLAQAGRTDHQHLGPGRRRGRALYPGRRAEERLRALPAGHRVHRTGNDQAHRGGEGTALGVHRQWRLRRHRAHGDQGRAGPAARRPRRRRHAQVRLSLQRPAEDLLRRRVRSQRRPPRRCPALSQRSRRPRHEAGRQPAAVAHRLPDQPQAPAQQRPGREDRPVQAQPAPHRGARPGFHLPALEKLALDAVLRQQLPDPAEPVDHRPLRLRAGPDPPAGPPRYHRHHLDRQVQLPSAGQPLDRPATELFRRPHRATRPSRGHRLLPARHRWQTDAYRVPGQGPGAAQHQPFRYRSATARADPGRGAAQAQARHPHAHAGQDLRDPALQLRLAATGIHAGRQAGHAELLHPGRDHLRQPDRHPIDALRQRAQRRPGQPGADLRQSQARP

SEQ ID NO: 30988 - protein, 168 aa, Pseudomonas aeruginosa
APHHRYRHARRMNEQDYLIAWGAYAIAGLGLMLVFWLMTGWMWRWLREPLRLIVFILLFTPTPVDPQNDLYAPAIAITALDVVFKVGNNAWRAVSDLALVALLGFGLYLLIAAIRWPLERAWKNRRHPSQDAEDEPTLRQMMQPELMPDVDTRTDEHGDRRMRIEPRL

SEQ ID NO: 30989 - protein, 174 aa, Pseudomonas aeruginosa
PFATKSILALRPAGVQHEARPMSGFPMDCVFCAIAGGREPAHRLFEDEHFIVLLDIFPLRPAHVLIVAREHAPHLSDLSAAARDALLALAERIGRALRRAGFGVEGINLLLNDGVAANQHVAHLHLHLIPRRRGDLPRLLWRALTRFLPVGRASLQARLQRERELLRTALLREV

SEQ ID NO: 30990 - protein, 258 aa, Pseudomonas aeruginosa
AMCELLGMSANVPTDIVFSFTGLMQRGGGTGPHRDGWGIAFYEGRGVRLFQDPLASVDSEVARLVQRFPIKSETVIGHIRQANVGKVGLSNTHPFIRELGGRYWTFAHNGQLADFQPKPGFYRPVGETDSEAAFCDLLNRVRRAFPEPVPVEVLLPVLISACDEYRKKGVFNALISDGDWLFTFCSSKLAYITRRAPFGPARLKDADLTVDFQAETTPDDVVTVIATEPLTDNENWTLQQSGEWVLWWGGEVLAKGRV

SEQ ID NO: 30991 - protein, 285 aa, Pseudomonas aeruginosa
TTTSRKGFTTMNYNQPATLQAAILDWAGTVVDFGSFAPTQIFVEAFAEFGVQVSLEEARGPMGMGKWDHIRTLCDIPAIAERYRAVFGRLPSDDDVTAIYERFMPLQIEKIAEHSALIPGALQAIAELRGMGLKIGSCSGYPAVVMEKVVALAETNGYVADHVVATDEVPNGRPWPAQALANVIALGIDDVAACVKVDDTWPGILEGRRAGMWTVALTCSGNALGLTYEQYKALPAAELERERTRIEQMFEGSRPHYLIETIAELPAVVRDINARLARGEMPQGN

SEQ ID NO: 30992 - protein, 137 aa, Pseudomonas aeruginosa
MPALFAPGAFSCPLCSPGLFLFLPVSGDARCAMSRVVAGSLVCLLLGSAPAWASTAEAWQAHDAMVRAACLKASGLRQVRAVGQVLPFDDEVGYSALLLQGCYPQPHMQGRQGRELCLYRRATGKASVSEADALLKP

SEQ ID NO: 30993 - protein, 562 aa, Pseudomonas aeruginosa
FCLRWKNMNMARKDFSSAALVIDKGSSSPIIADHLSKTINFVPESYVINFPESPLTVRKLDFGRYYGVGCDEVTYYCHKVIEVLLGSAIASQGKTKSVASIITYAKRVSRSFLCYCSFMSMAMKGEIGLRHIDRGFVASFIRYLEASGAGYTTQKNIYTCCKSVLGELVRCGLLSSDIFPPNPYPHSNRRKSSEKAFSKKEFTQVINALKREVIAVKEASGPILAEGLAFCAVAIVARTGLNLTPLIELSMSCLLPHPLRRDRSILITYKRRAHKVNCQSVSSGAVSTLDDEVDTLSVVLPDISAIINMVAERNESIRSRGEWKDRLFVRERPLKNPDERTPAPITINTINRALEALVVRHELISDNGDRLVVNVSRLRKTFANKIWELSGNDPFLTAMLAGNTPKVLLDSYLEAPDDAEKNWALMGEVRNKELLENDHADFGIIPVKEVNTAVARCKDTVNGHRAPKNGSHCVEFLNCFRCSSFVVTADDLHRLLSFYWLLVRERGRIGAKKWVRLYRHIIKIIDEKILPKFDKSTVVAAREKARQNPHPFWKDPEILGLA

SEQ ID NO: 30994 - protein, 376 aa, Pseudomonas aeruginosa
CPNKRSKRVKGFFNGALLLGTVLVSSLSSAADLTLMSWNAMRLGQGGEKSFPALAEVAGKADLVAIQEVMNEEGLTKLEAELEKRTGEQWSTLVSHAVGSRSYKELYAFLMRESVVVYEDGAVVYMDRGDRFIREPLSARFKSKRDGTLFAVASIHVLYGKGPQDREPEVRELESYWAWLESIYPETPVMLVGDFNMPPSHPAFSGLSQHATPLITKGATTLSAREGLYANLYDNIWVSRTHRLKQDNAGIMDYPRMIGWSHEKSRKHVSDHAPVFVTLGNAKLRQGVVTVRPEAERSRVAGGGLKQIFPSQAQKSTAAIASNIDDADHIRGNANSRIFHWPGCPSYDKVSPKNRVEFSSVQEAEAAGYRLAGNCR

SEQ ID NO: 30995 - protein, 429 aa, Pseudomonas aeruginosa
PIPFLFQLGLGTSPLGVAIRLCFSDNFSTLLNTKPCVYEVLKDAQDAARLIFRSWRYTPVECWMPVDTRRAPVIAPSTINMADRLFCPAAATLRMHILIWFLEGQSSQRDIILGAREALPPEVRIFASHRQDRPEITGSADVSFLEPKDNQERIDWVIETALMHGIKVILAGRVGSVFEAQRHRFEVAGLVLVTGGSSMGTFELVDDKSKFTAEAERAGLACVPAITARNAKELIDAYESLRVHGDVCVKPAVGIYGQGFWRFKSEVDSFRCFANPASREVQFETYLNAYRAGADRSAMLVMPYMTGSECSIDMVCESGRPVAFVGRRKEGLHQTFENASPAVELALKAAAHFQCDGLVNVQTRDDLDGVPHLLEINPRYSGGIGYTRHTGVNLPGIFATRRLGLAEPVSDWIPNIRVKAITVAVPVAT

SEQ ID NO: 30996 - protein, 396 aa, Pseudomonas aeruginosa
YHFAAFSKVRDSRSKAGMMVIAPGANTALGAAQCSWTLECGNPSAFGDYAAVAMLPLDDKRHPKGEAALFQVSQAWMQWSGGQEKICCNLNLGQLPTGADRVLLVVYTFSAMGPVSDLRLLRLQIDSQIEFNLNLSDNGESAIIVGEFYCRNHQWKFRALAEGSAYGLAALGRRIGLKIDDAHPHRRSSSSEQSRPASGATGTGFAVTSTHILTCAHVIEDMKEIHIASFEGRHRAEAVVVDQRNDLALLRVQGAPAFKPVAFRDGVGCDLGEPVVALGFPLAGLAGGGVHVTQGGVSALFGLHNDSSLLQFTAPIQPGSSGSPLFDAAGSVVGMVTSTIPDAQNMNFAVKAGLALAFLDACGIEPARTPTGKTFSTSQMAREAQQSLWKIEARNP

SEQ ID NO: 30997 - protein, 254 aa, Pseudomonas aeruginosa
FSMGTNRPLVFVDLDDTLFQTSRKMVEGTPRTTATLDVHGQPNGYMNPIQHSFINWLLASADVVPVTARDVEAYSRVKLPFTEGAICSHGGVMLHSDGSLDQDWHGQMAESLWGFQDRLPALSEATLRIGKDMGYSLRGWVVEEEGLRHYVVTKQNESDDAVLSKVLAEVQARGMLEGMHIHANGNNLAFLPKGLAKRLAVQEWLRRDAKINGDRPVLGFGDSITDLGFMGLCHMWATPARSQLAKAVEEMIIE

SEQ ID NO: 30998 - protein, 353 aa, Pseudomonas aeruginosa
RRRATPTASHRARRGNGGGGRRGSWTLSCGNHHPEHELMKAISPFALGATLYMPATRDDILDVVFGMKIPELRSLVVCLEDAVAAIDVESALANLQALLMGIHARGGRPEQGPLLFLRPRDAEMAAVLNGWPLMKHVNGFVVPKLTLKSLPFWEAAVSNPDLYLMPTLETSDVYDPGAMVELGQALKANLNQRIIALRIGGNDLMGCLGLRRNPATTLYNTPMSYVIPMLAGVMGAQGFALTAPVFEQLATPHLLQEELKLDIAHGLVGKTAIHPSQIRIIQDTLRVSLEDLNCAKLIVNDVAPAVFKHNDAMCEPATHYKWAVNILERAKWHGVKTAEMGNGEHSVRLAEAY

SEQ ID NO: 30999 - protein, 241 aa, Pseudomonas aeruginosa
ALKCWRLGRKERMCSRCLTSMALSPGTTASCRSFGLPSALASSPNAFSGWALPTLRYLSRGMSRDELKAQLIGTFLAGVEAKWVCQKAEDFCQLVWPKLMRPSGVRSVAAEIASGAEVTLCSASPALVLRPFAERLGIKLIGTELEVVDGHLTGRISGNNCRCENKVRRLEAIYGPLTQYRLRAWGDTHGDHELLDAAQDAHWRHFHPAWRRSRSRYSKAGSPESVSPRDSHSNSEDQQGA

SEQ ID NO: 31000 - protein, 152 aa, Pseudomonas aeruginosa
EEHMLEWLKTNATKARETLTTEVAKFKNRTFMEAVANACALISAADGEIKSEEKMKMTGFINNSPELKVFNLNDVIKVFSDACGKFEFDFQIGQAEALKAISKVKGKDGEARLLVRVASAIGASDGDFDDKEKAACRLICLELGLNPADFEL

SEQ ID NO: 31001 - protein, 348 aa, Pseudomonas aeruginosa
GNLNVETTHIGFPPLTMAVFVGLALAALLLDMVTHRDDKPITLARASIWSVFWVAISLAFAGFLYVQHGAEVASLFVTGYALEKVLSVDNLFVFMAIFAWFKVPDGLRHRVLYWGIIGAIVFRGVFVVIGTGLLAFGPWVEIVFALIVAWTAVMMLKGGDDDDEEEDYSQHLAYRFAKKLFPVWPKLYGHNFFVSRKKLEVEVQKPENKDISLAAKGGLFATPLFLCLVVVEVSDVLFAFDSVPAVIAVSREPLIVYSAMLFAILGLRTLYFVLEALKRYLVHLEKAVIVLLFFIAAKLGLNATNHLFHHGISIDPNTSLLIVLAVLAVGILASVIFPEKEEAQVENQ

SEQ ID NO: 31002 - protein, 199 aa, Pseudomonas aeruginosa
TESRNHIMAVSLQKGGNVSLSKEAPGLTEVIVGLGWDPRVTDGTEFDLDASVFVTGENGKVLNDASFIFYNNKTSADGSIEHLGDNRSGQGDGDDEQVNVKLNGLGADVKKLVFAVTIHDAEARKQSFGQVGNAYIRVLNKADGKEIARFDLSEDASTETAMIFGELYRHNDEFKFKAIGQGFAGGLKPLAEAHGVSIG

SEQ ID NO: 31003 - protein, 409 aa, Pseudomonas aeruginosa
AARHFQRTSEDEMGFRFSKRITIVPGVRINISGSGISTSVGPRGLSLTMGKRGTYLNAGLPGTGLAYRERLDRSGTRNAPNPAAASAGYSGPIKVKVDDDGSLIITDLEDAPLPPAIVKRVKVEKSDEIQALLEKAAAKINQALDECLSAHMMTPRPGSLPALPPAFDRDEPRRPSTHAPGLLDKMLLRSSKMEKEAQELEAQYQQDLFEWTAARDAHEKARSDIDKAIRLAAKGYSAQMERALDYVLSGIAWPKETLLEYEFSHDVSGIALDIDLPDEGDVPNRTAEARGNGKLTFKTRSEAQTRKDFVSLCYGTVFRVVGEVFALLPGIQKCLASGYIQRTDLATGSIGDQYVISALISRDQWETLDFNRLEAIDPGATLKAFGAVVSVDRTSRFREITPMDLATLG

SEQ ID NO: 31004 - protein, 79 aa, Pseudomonas aeruginosa
IETVMDKLAKALGERIRMQRKVCRISQDALALACSLDRSYVGRIERGEVNITVEKLYRIAGELACDPSSLLPPPSEILS

SEQ ID NO: 31005 - protein, 77 aa, Pseudomonas aeruginosa
SRCSVGLVKISEQLHEEARIACKAMSRSINAQAEHWMRIGMLIEANPGLTYAQVLRQLMDEARESDRREQDAARISG

SEQ ID NO: 31006 - protein, 304 aa, Pseudomonas aeruginosa
VEKETERVACMSGELASFEVDGYQLVYQDLGEGTPVLLVHGSLCDYRYWQWQLRSLGEHHRLIVPSLRHYYPERWGGQGADFTSARHVADLLALVERLGEPVHLLGHSRGGNLALRLALAAPDALRSLSLADPGGDYAAEVYAHAGLPAPEEPLERNQFRRQALELIRGGEAERGLELFVDTVSGPRGMETLVGDVPPNDAGQRHDPGRAGGRPAAGAGAVGTALDRPAEPDPQWRTQPAAIPGHRRGAGGGPAARRAATHPGRVPWPQCHPSGGFQPVGTGVPGARRWRCAGRGNVLKRGRAN

SEQ ID NO: 31007 - protein, 199 aa, Pseudomonas aeruginosa
AVGTGGFPAWSPRLGVIIIKREMRQDKRAQPKPPINENISAREVRLIGADGQQVGVVSIDEAIRLAEEAKLDLVEISADAVPPVCRIMDYGKHLFEKKKQAAVAKKNQKQAQVKEIKFRPGTEEGDYQVKLRNLVRFLSEGDKAKVSLRFRGREMAHQELGMELLKRVEADLVEYGTVEQHPKLEGRQLMMVIAPKKKK

SEQ ID NO: 31008 - protein, 119 aa, Pseudomonas aeruginosa
FMARVKRGVIARRRHKKILKLAKGYYGARSRVFRVAKQAVIKAGQYAYRDRRQRKRQFRALWIARINAGARQNGLSYSRLIAGLKKAAIEIDRKVLADLAVNEKAAFTAIVEKAKASLA

SEQ ID NO: 31009 - protein, 124 aa, Pseudomonas aeruginosa
RPGLRHMLEPSHNDELPPIPGKRYFTIGEVSDLCAVKPHVLRYWEQEFPQLNPVKRRGNRRYYQRQDVLMIRQIRALLYDQGFTIGGARQRLSGDEAKDDVTQYKQLIRQMIAELEEVLLVLKK

SEQ ID NO: 31010 - protein, 597 aa, Pseudomonas aeruginosa
VENNTMNLSSTIKSIQDIMRKDDGVDGDAQRLGQLTWMLFLKVFDQREEEWEDDKADYQSPLPERFRWRNWAKYLPDADGKKKPQIAGSELIGFVNNELFPALKDQIDADRSPQHKVIREVFRDANNYMKSGSQMLAVIEKLDEAINFHDFKTRANLGDVYEQMLNDLRGAGNAGEFYTPRAITAFMADRVNPRLDKRETVMDPACGTGGFLTAAIDHFRNQLSIKSSAEDKRAIEDLIHGIEKKQLPHLLCTTNMLLHGIDVPSQIEHKNTLGIGWNEWSANDKVDCIITNPPFGGYEDDGVGSDYPADLRTRETADMFMALIIKKLLKENGRAAVVLPDGFLFGDGIKGTLKKLLLRDCKLHTIIRLPKGVFAPYTTIKTNLLFFTKGSAVDDGTEHFHTDTIWFYEHPYPPGYKSYSKTKPIRLEEFKPERDWWGSEANDFADRVENEFAWKVDFKTKREQAEAAAQPHWLRAEMLNTQAAVLEGEARDLRNSLVGSTDAAYREKIEAQIAELRSQAEPLRLQARDAQAAGDRLYWPIFNLDLKNPNAPEEETHDPDLLLEKYKKLLGEIEETENQLKSELAAALAHHFVGEDA

SEQ ID NO: 31011 - protein, 586 aa, Pseudomonas aeruginosa
APDMQLLRISIPAFRNLRDLDISFATHLLPGEGAPADVQPKQIRSHALIGQNGTGKSNLIEALITIFRDVDLDREAAFDYTLEYSIRGYAVRIEADTAKQKRPYVWVDGKAESQRYLLKNRELLPAHIFAYYSGRNERIEALFQEHQRRFNLRQEITTDEVLPEQLLENFTGTEADILAVEDAKRRRETRLRQAGDDRLRRLFYCRGGHSQLVLLACLLSDDPVFQKVLKNLHIESLESALFVLKEPHRLREKRRGGKFDEQELNEGDPRFWYARGNVVSEFLDKLWQVSWAPIEQEATKQIDFRGRTEKQKQLYLFVPSQEKLKQLGELVGSTDSFFRYAEGAYIGDLIDEVRITVKKRDEHGGKVSFTHLSEGELQMLTVLGLMRITREDHCLFLLDEPDTHLNPIWKLRYFDDIEGVLTSEDGTLVQGDSQILITTHDPMMVGSLKREQVHILRRNGSRTVVDIPDMHPQGMGVTGLLKSELFGLSSTLDIETERRLFRRNELFVKQPRTPVEDAELSRLSAELADLGFSTADFRDPDYALFVRKMAQHRRFRKPALTPEEQAEQDAIADSIIDEILREEAAE

SEQ ID NO: 31012 - protein, 180 aa, Pseudomonas aeruginosa
PARQHAAAGSAGGDSQSAGALGPVPPVGLAARCFAHWLAAGSATPSGTARSTDRHDARRCRFAPASPAPPPAVLSGLPFSPGDHFQRLDVEVGLGEQLLQSAVFQFKILQPFGVRHGHTAKLGPPGVERGITEAVSATQFLHRHTGLRLLEEVENLLFGKTLFHCRLLLGKRTLLSLTWY

SEQ ID NO: 31013 - protein, 635 aa, Pseudomonas aeruginosa
RFLQLSVRSLGGLRCCRGMGFRAGRQGLLDGGAQPCAFVVAVVVPALGGNPVEVRDRPPQHRGSPDFPGAGAFQQRVAGGVAFDADGVEAGGRVLDGEVEAEGVAFAGGCGGPAQRADVLADDLAEAVVSLVVLAALVAAVGVQALEQLAGTGELAGGQCAGVFQVALQVVARAARRALGAEHVGDVADRHRGDHHHLAPRAGHRHVEAALAAGLPEHAEVAPEAALAVAAEGGGEDDHVALHVLHVLHEHAHVLAVFAALALLAVGGAERLVLLGAQFQALLDEVGLLAVEGDHAHRRPRRVGLAPEFGEVVDDSLGLALVALVLVQAVHLDQFQRLDAQDVGLRMAYRHAQAVAVERGVGEADQLAVGRAVVDLQGGAGQGVARQLQEVRAVLDLAAVPGVLVGFALLLVGVLVGRFAVEQFGLVAFHAAGEERGRRHLLLVAADHRDPPAIEGRQGELHRHLRGFVVDHHVEQPGLERQHAAGQVGVHQPDRAQAHQAEFGAQLDELAQAPRALAGQAGDVFPLLAAAQARGADALAEQFAVQRAHLHIGFGEAGDPGPGFVLAEQQFRIVLFQALLPAQPRFAVEHAAHRGFEFFGGNRVESFLALAQQGQEFQVGGFELAGAATEALVGD

SEQ ID NO: 31014 - protein, 1200 aa, Pseudomonas aeruginosa
PEADQRRAVFLQARQAADVQRRQALAQGREVQRRRAFLQLDQFAEQAPVAQPGGLVHAVQALVVAVQFAFQRLDTRRQALALALPALGAAGFGEQRFELLADVADHRFAVAVDVVEHDDALAQALGHQALVHHFQGGVLLADDQQAALAADGVGDHVDDGLALAGAGRALHQQPRALPGLQHGGLLGRVAGHGEVALQLRRALAGFRLAVLAQAQRGLQSGAGGRQALQLAQVLADRLAHEGDVEQHRGAGQLVLVGRDLGGTRWQSFQHPSTRRGEQAEGIHHIGGAQRGAAEQFVGDLAPALARLGAEQAFQGRVEAHFLALAVEGKRHLAAAADFQLQLQRPQQQRHDARAGGAARVAVEQEGEAQVEAVDAGVTLVQRALPGQRVEPHFQLRVGEEAVRVEAHRAGVALQQMVEQGGGGASRAVQFVEVDAWGALADAHAHQRPAHHRGDHFLLEEIEDLRHVLLLLRFQPLFRRDRQQHQDPRQRHAPLQAELLGPFVDPGHAAAGEAADAFVDAAVQLLPRVLQQAARGLRVEQVHIGVAGQAGGFLDDRLGGTELADVGAEQDDQVFLGDHPALGQGQQAGVLGVRQEALALLPLRGEARPRGRQQVDAQLFFGEFDVLVQGALADVLGAGLEPRQPAFGVQLFEQVGHRAADQPVALQRMLQQPAGGDDLAALDQRDFRVQQLERQHQPEVVLQPLVLGHLAQAGEQPGRQADVLGPGDDRPAQQVVEGLRPVLGLGRGQGEDRRLAEAPCAEGDAGAFGVVLFAVRRGRRVHRLAVQPGLYLRPLPALVAVACKQAAQQQVQLRVEVVGQRHAVGQHVDQEGVGVDSFEAGAAGQLLQQDHAQAPPVGSRRHAAGDRLGGHVAAGLQRRDDIQVELRQARRAEAADHQVQWLVAAHQQAGRAQVAVAQAGFVEHVQGVAQLADHVAHRLAVLQHGAEVGEAAAGELLDHFVGALVPAAGGEDFRYVFARQAADHVVDRRVRLGARAIQGEHRLAGAFRVFGQVALAHAVAAGDLPQQTPAVDQGFRDGGLRRGLGLHRQRAFGRRGAALQAHQVAGLQRVAVGAERGGRRWRLAGGRRDGFLGQHRLWSPAGGMDGFGGKVPAAGLALDRAFAEDFRKRAFALAVGAETYHRYRSIQRGRWALTLSWWPCSRSRSCSRSRSSRRGMPAIHTLPSWSNIRSRALSSSRSGRW

SEQ ID NO: 31015 - protein, 598 aa, Pseudomonas aeruginosa
TRMSARLRWRSSPSRARRAANCSKGSPPETVMPSACSSHGWMSASRRARAMRRRPGPQVSAEMQPGQRMLQPWNQMPRRRPGPRVVTGKCTRDRLSSISAAFQGQAVGVQGADQEALARLRVLVEQCPRQRVEQARFELVADAAAAVGQVAQAEVVQRLARRLGQFDDEALLAEVGEGAVDHLGEDLLGDVGADEVEDDDVLADPVEDFRAVENQLEVALDLAVDLALHRLEGLAGEHVGDPFAVFPLAVDAQVRGAHDQRLGEVHAIAAPGGEHAVVEDLQELVEDPGVGFLDLVEEHHAEGFFADRVGQFAADVVADVAGRRADQALVGMLGAELGHVEADVGALVAEQQAGDGLRQLGLADPGGPGEEGHAARAVALAAGADPGHRALDDVQHVGHRVLLALDPAADDLVGLADALAVDLQPGVFGDADLVAAHGVGDAFHGQAFHARQLDDGVEIEEQQAFGVLDEGCGGLLQGLLGDARAAEPAEQRRGQGPARRLVGLRHRDMAQARVVHQQPVGQVAFLFHHPQHAVEERFALFPGGTAAGLVGEHQGLGEQLVLGGAQGVVAHRQARGEVDDQGDRLAATVDQALQGRAE

SEQ ID NO: 31016 - protein, 362 aa, Pseudomonas aeruginosa
SLTACVVATAYCPEGHVSNPDLAGDDENRYEFRVPGLAERLLNRRSSGSPSGTPAPPPRSRGRSPGAAGFRRDRDAAATDGCRAPPARRNHPARRVPPGAASRPGAGRSLRGRPRRRPSPARCCRRVPAPRSPGCRRCAAGWRSGRAGRGSRRARDPALRRPRRAGARRLRGRGRRGSRRGSAGRRRTVRSGSVLAGQGTCRRPAGAAPGRRRDGAGRGGSCSLPLADSAVGEIASRRFRDTGGLRSEQYGQRVFAQPRFPQSSPGPGGRAHGVEVAAARNIDRIEAFEHQVGGGLAAGIQVGVESLVGRAQKDIAPVRQALREERLGDLQVLFEQFVHAASLLLLEQRHSSLRPSPSRSLS

SEQ ID NO: 31017 - protein, 444 aa, Pseudomonas aeruginosa
LLCKALGRSALAGLLYGGDIDPAHRHHRLEGAPGRRAVGAGDGFAEYARGDLPGDAPLVTAPAAGAFLAAIVDDSVPQAVGLGLVVGGDLEGERFAVAEGRAAVEPEAGNAHHPELHRQYVALLAGRVIAGRAMDSQHGAVGKCLGVEGRGLQGGAVVPEADGVLAVHGEVSTGGVDPASLVGWRAATWAGAEREVAPRVPICATLCRVSPGLAGLSGQRLGGAPSTMQGQPMEAVSVSQHLAALFESHRIDCVVHGEWVAPAGRLPAIRATWYAGEKTGRLDVDVLLEDEHQLQEAFAGIGSAEDGLQDALRNFASSSFHVLLSALWGQAEEDQVMVETWEIGERRFEVHIGNLGLRGAEGKAPPLPAGLFPSIERAIRTEPLDARLHWFRHFFCAFGNQRTVEALFDNQPWEAGMQNLAALDWQDSQGYYSVRNFLMLKPLA

SEQ ID NO: 31018 - protein, 481 aa, Pseudomonas aeruginosa
RDGRQPCHDRPRRGGPGKRRATGEIPPLGAHRAFRRRAVLVADQPSRSADAGQSRPAGLGTLGGAAGTGRDVQALRYAEGDGRGDDRRGDPAVRPQRRPGRAGRLQRGGDPCRPRLPAQPVPLAAEQPPQRRLGRLPGESRAPAAGDRPGGARRGCPWLRGGGEAEFRRFPARRLQRRRCPRGGTDARWPGRRPGRAVGRQLRGAGHAGRSARRADPGPRGLLRRVRPRHPRGGADAGNGHGRHPPAAGGRAGAGQRGGHGWHRHGAGDRAEPAARLARRQGLGAAVAADNLEEQTPGIAGEHGRGEVPAAQAEPGQGDQPTGVAAVRVARAAGRRAPADPPLPAAHAFARRSLSTVSASGAVAVEFGQLARQAEPGVVVVGRRLLAGDLRPVGMRGEFAIEGDELPLPERHLVLGANRGDRAFRLAERAVDAFIGVDDEEVGAFVEAVHGTDFHAVGVFAADAFFQHDEGHDRPPWLRRS

SEQ ID NO: 31019 - protein, 260 aa, Pseudomonas aeruginosa
NGRRFFRENPMKWQEVGETPCSMARSLAILGDRWTLLILRNCFLGMRRFDEFQASLGVTPPGTGRPPEPAGGGGRAEGRCLTRSDRRATNTASPTWARTWHPVLLALANWGDRWLDEGRGGSGGVCAQGLWPQVPADHGLPGVRRAGGGARCDGGAGAGVRGDGWQARAELNPRALCQGRAATRSVRSAGLAEDEHQPHHDQPHAQQAEPAEAVAEDHEVHDRGHRRHQVEQAGDVDQVALGDQPVEQQGRAHRDHDAHP

SEQ ID NO: 31020 - protein, 219 aa, Pseudomonas aeruginosa
RGDQEAGVPFELERLEGHERQAQAEAGEVLQGQGAQRVLADALLHDRAAGDAGQRQQCAEDAGRGHPGQADALVDHQHQAGQAQQQAEQARRRLPAFEDDGGEDRLHAEDGRHHAGSDLQLQREDIEDRIDPQHHQAGEQGLAALTRAARRAQPEQRGERQQAGQGDAEAEHQEGERRGVRQAPFRGDGPAAPEQDEEAGAGQAGQRGFVQCKHGSATL

SEQ ID NO: 31021 - protein, 777 aa, Pseudomonas aeruginosa
RAALRMIRKKSGPGESMPRVARVATKSEVSSMIRYAWRKAAPVRCGAAGRWLLGQFLFAEQAVEEHARKIALAGIGEDHHDGLALHVRLLGQAHRGGHRRAGGDAAEDAFFLHQAQRHVLRFVVADLLDPVDQRQVEVLRHEAGADALDLVRGGLDLLAGEGLADHRRGHRLHRHGEDRLAPGVLDVARDAGEGAAGADPGDQHVHRALGIVPDLRAGGLLMDRRVGRVVELLRHEVLPGIPRDQFLGLLDRTLHALRRFGQDQLRAQRLEHLASLQAHRRRHGQDQFVAACGGDEGEADAGVAGGRLDQGHAGLQSAAGFGIPDHVRADPALHRIAGVAPFDLGQDGDAARGDAVDLDQRRVADGLRVVCEDAAHDGVLVAWRKINQPIPPPPARPDAFEPAARRACPLSRRAVPMKKRYAIPLGSLAALLLLLLALHLALPYLVRDYLNGKLADMGDYRGHIADVDLALWRGAYRIDGLSIVKDNGKVPVPFLDAPSIDLSVSWQALWDDHAVVARVVFERPQLNFVDAGGDRDASQTGAGTDWREQLDKLLPITLNEVRVVDGTLRFRNFTSKPPVNLHASALNASIYNLTNVADARGERPARLEGTARILGQAPLEVAAHFDPLSDFEDFDLRLRVTRVELKRLNDFASAYGKFDFNAGTGDLVLEAQAKRGQLDGYIKPLLRDVDVFNWRQDVEDGDKNLFRSVWEALVGGGETVLKNQRKDQFATRVNLSGNIHQRDVSAFQAFLGILRNAFVEAFNARFERSPATRDDDG

SEQ ID NO: 31022 - protein, 318 aa, Pseudomonas aeruginosa
MTRLRSQCACPRVIVGFSNNTELPGFPARALPFEDFLMKFEGTQSYVATDDLKLAVNAAITLQRPLLVKGEPGTGKTMLAEQLAESFGAKLITWHIKSTTKAHQGLYEYDAVSRLRDSQLGVDKVHDVRNYIKRGKLWEAFEAQERVILLIDEIDKADIEFPNDLLQELDKMEFYVYETNETIKAKQRPIIIITSNNEKELPDAFLRRCFFHYIAFPDRETLQKIVDVHYPNIKQSLVSEALDIFFDVRKVPGLKKKPSTSELVDWLKLLMADEIGEAVLRERDPTKAIPPLAGALVKNEQDVQLLERLAFMSRRASR

SEQ ID NO: 31023 - protein, 290 aa, Pseudomonas aeruginosa
QVDRYRRYQSVRLRRFQPGGHPRRRRRQAPGQGGQGLGPARIQEPRRPGRTGYAQHQDRPAAPAQVRPRGRGGGAGHRRHHRPHREGRRAAQHPDAPGAAQHGEAVAAAGHRRLDGRPRQGLRGAVLGLQDRVQAPGVFLLPQLHLRVGVEEQPAPQQRTHRHLRPAAQVRSGLQGGVRRRRGDGALRNHPGRRQRRALERGSRLRLDAALHGEVQEAHLDQPLSEGHLELHGVHRPGPRTGQGTDVSVDPERPGGGHALPLARLSQLPAGPATGAAARNLPTLCIPSAR

SEQ ID NO: 31024 - protein, 236 aa, Pseudomonas aeruginosa
QRGAATGNDGHAMIDSTFSRATWLNSLHMSTLTLSLLEKEGFAREQLLEGSGITPADLLGQPLPLLEAAFDYAGDEAMARAYAEGFACELHFERERSAIGFAAEWLERPLPLADPVTHREMLEQCRRQNIDLAARRAWLDKVRAILAERLQDPPGLEELARRLNCSSRSLRRHLQQQRTSYQQLLDELRFARAKELLQSGDMPIYRIAEELGFSETASLRHAFQRWSGQPPSHFRA

SEQ ID NO: 31025 - protein, 141 aa, Pseudomonas aeruginosa
AASPAPANRGCAAAPGPAAPVRRARWRAASGGRCRGVRAGAAGTRRRAPRRRRRCPAAGRSPWRCHAVRRARSGAAATCRRWRRGRTPPRAPAPIAVASSCGCSASRRAGRRTGVPPAAPRARPRVSRPAARRSPRRRRGR

SEQ ID NO: 31026 - protein, 823 aa, Pseudomonas aeruginosa
VQRQQAGAGMATSAVELEAGEAVEIEAETDAAGSIGRLQVGDQAVCPFLAVAAPGVRAAIVVVEEVVAVEQAPLQVVGRLGFLCRGVARRGAAQRQEKGQAADRSNADHRENSGRGGPRRARPGTSESEAGTAECAPETLEVAHRYVGVARAVVLVGVYRAGTDALVDLGGQRRALPPVAGYLGHRRPVRQHRRRRRTELVELGGGIDDLAVDHREHRLDPLDGLFLDAEEVRRQRRQVGELANLDLSFLALLAGEPGAAVGEQLQRGFPRQALRIQGHAADGATADQPVQRGPGVVAGDPGGVGAGTHRHALGEHALDRRRGLGGLGTVAVDEVLALEGHAVLDRDAAAECPHPLDVARGDGLGVVEEPGQAVERNVAVDLLEHVEHPRDRFIVGGVQAERPALLHQVADHWLQLLLHGLRQVRARFEEVLEVGGGEHQHLAGAVVAEEIAALAVLDAAGPVLEVGEFFLRFLGEQVVGDAYGELALVGQFANHLVVVRVVLEAAAGVDRAGQAEAVEFAHELAGGVDLVFQRQLRSLGQGGVENHRVGPGDQHAGGFAAAVADDLAAGRVGRVLGVADHAQGGAVEQGAIVQVEDEHRGVRRGLVQFLQGRHALLGELELVPAADHPHPLGAGRAFGLVLEHAQGVGQGGHAFPAQLQVVVEATADQVQVRVVETGDHGALLQVDHLGGAAAMEHRIGVVADGKELAVLDRHGGGGGVVAVHGVETAVVQDQVGGHGTSWVACGRKAGGVGEGQGGPQDSGGAQHRTGSEEMAAVLARRIVAHGVLLAAGRNRSARAAAREATGQDRCGGKRTGRKSGFPE

SEQ ID NO: 31027 - protein, 425 aa, Pseudomonas aeruginosa
GGLSILLAGNPSFIVSVCAFCMDVSNILNIAVQLYPGPQFSDLFSRKVCFFQYSCFIVWPATGNYLLACVLLCATAGIHRSLSGNNHEPLSRSSNSAEQPDHLHRPAATDGIRRTVHRSPDAEEQRSGPGQGGEGIRHPGHHHHGGNRQLLRPDLSGAAGGVPRAEDPRTHLDELLGRPERARLAGRRGPQEGRGRRAVDRGLQHHLRPLRHARGRLRDLHGGRCLGRHLQRRPQVRHGPHGPGRRGTGDLAAGPAGVAARLGPPGYLRRRDGHRQGAFRGLRHGRGLRLHHGAQGARAGDPRRTHRPESGQVNAGRAAPVRRAARPRRRTKMKLYVLSLGAGLLVGIVYSLLQVRSPAPPLVALVGLLGILLGEQVIPVGKQLLGGCAFASACDKAGSVGHVLGQLPGRHRLDQAAGPSEKEKG

SEQ ID NO: 31028 - protein, 399 aa, Pseudomonas aeruginosa
RTVRKPPDARLECPGFGGRHWPPTSQRNRESQMKAVRQGRGVTGLLMLLALAGCSSRSAEPPPPNPDEVRAKIVRLMPATVRDRQGWASDIYAAFSAQQIYPSDENLCAVLAVTEQESTYQVDPPVAGLGRIATREVERRAGKLHVPAFLVSSALNIKSPDGRTYSQRLAAARTEKELSETFDDFIAIVPMGGKLFGGFNPVHTGGPMQVSIAFAEQHADGYPYPLDGSIRREVFSRRGGMYFGIAHLLGYPADYPAPLYRFADFNAGWYASRNAAFQSAVSRVSGIPLALDGDLIRYGTRTPGSTELAVRSLGKRLDMSDAAIRRALEQGDSPEFADSALYRKVFALAESATGKTLPRAVLPGIALESPKITRKLTTAWFAKRVDERYQRCMARVRKR

SEQ ID NO: 31029 - protein, 312 aa, Pseudomonas aeruginosa
VSRYMRLVSWPSICFTSVVAVGVLRVAGVNVALAAEAGLELDGLLGRQAPAEQPVNVLVAHAFATGGEGAGLLAGAVGFVAGVDVPVVRVGLGDVAVDAVAEVFRERPVETEAHPFAGAFGLVLREIAVDAEITVGFRAGLLGDDVHHAARRAVAVARRRRAADHFDALDLVGRHPVGVAAAVALAAPAVAHRVARADRLAVDQDQGVLRAHAADVDLPVVATLAAGAVAGQVDPRHGPDDLRQVVARRSLGDVLGGDDGNPRRLLGFLLGGGDHGLLAQLDDGAVALAGGVYGVGEQATGQQQEGNGGKGA

SEQ ID NO: 31030 - protein, 180 aa, Pseudomonas aeruginosa
RMALRRRFSMAWARLSRCTSTRQSTPKRQGSRAGSQPLSKQASSRSASHTDSASTGSVGSCGRSVSIQARSRVSSSSRCMSPISRSRRWRNCSGGSSLSWAMRRRASGVRSSWDRVRSSRRCWARLRRRRSAMCSRAWASSPSSSRRAASGAARGVLSSSSARRASARSRKRFSGTTRWR

SEQ ID NO: 31031 - protein, 151 aa, Pseudomonas aeruginosa
ISQVSSRQKPTCSSASFHNSGCLRIRGVPSPPAGSPGRVPPGSAGDGRRPRRVCAAGCRRARRDRGRGACSCGAARSGRGTACSAPRQRVRGASPGGGTRMASAPPEGPGGAHPGPGRRTPAGYPAAAPTAGGPVVRGAAGRRCGHPARPG

SEQ ID NO: 31032 - protein, 1128 aa, Pseudomonas aeruginosa
MSGLPVSHVGEKVSGGVISTGSPTVHVGSSAVGLADRVSACVPLVGKPVNPMLGSKLLPEEVDFALAAPDTFTFARGYLSSNPRIGRLGRGWWLPGESMHLELSEDACVLVDAQGRRIGFPALAPGAQHYSGSEELWLRRGGSSGGEAQAWRGRWAAVPAELQTQEGSVLVLSGHSYLHFQRCPDGIWRLQASFGRAGYRTEFRWSGRGLLTGVRDSAGRSYALVYQQACEPSEGDDGLRLFGVILASHDGPPPDYIDPQSPGLDWLVRYQFSDSGDLIAVRDRLGQVVRVFAWREHMLVAHGEPGGLEVRYEWDVHAPHGRVVKQIEAGGLTRTFRYLRDATEVSDSLGRVERYEFAGEGGQRRWTALVRADGSRSEFDYDLFGRLVAMRDPLGRETRRRRDGQGRMLEEESPGKARYRKRVDEETGLLVELEDAMQRRWTFERDERGNATTVRGPAGSTRYAYEDPRLPDRPTRIVDPRGGERRLEWNRFGLLAALTDCSGQVWRYDYDNEGRLVASSDPLGQLTRRRYDPLGQLIGLELADGSALSYEYDALGRQTRIADAEGHATLFSWGHGDLLARVSDAGGGELSYLHDEAGRLVALTNENGVQAQFRYDLLDRLVEETGFDGRRQRYRYNAADELIAREDADGRETTYAYDRDGRLASIRVPATEHAPALVERYRWLADGRLASAGGADCEVRYTYDEVGNLRLESQVHADGWVYSVEHSHDALGVRQTSRYGDAPPVAWLTYGPGHLHGALVGAVELAFERDALHREVRRDARRDGQDDALFTQERQHAPLGRLQRSRLRLAGGFDWQRGYRYDGLGQLVGIDDNQYPSVRYEYDLGGRLLASRRAGAAASTYRYDAAGNRLEGVGEYAREDARQAFAENELYRSGFSRSEVRANQAGEGPARWAGNRVERIAGNRYRFDALGNLVERIGADGERLRLAYDGAQRLVHLTRDYADGTRLEARYRYDALSRRIAKVVLRDGVEQQVRFGWDGDRQCAEAFARELRTTVHEPGGFVPLLRLEQACEPDPPELLQLRQAFAAEGQPLPAQCVPALGEARIAFFHTDHLGTPLQLSDERGQLRWQGVPDDWRAVAPERQPGAQPIRFQGQYHDEESGLYYNRYR

SEQ ID NO: 31033 - protein, 188 aa, Pseudomonas aeruginosa
YLPEAGCYASQDPLGLGGGPNLYAYALNAPTMAYDPTGLIIPLVVIGAFAARAAIGAALGAGIELGMQTGKQVLGQMKDNWDSDRDLTDIKWKCIDINWKHVGASAAIGTVAPGMLSTGKTVVQSAKAIRTLSGQAANTANRAAKLAARKAAHADTIKKAVATQAAWQTGKQIVKCPLKDEEEECPPQ

SEQ ID NO: 31034 - protein, 561 aa, Pseudomonas aeruginosa
SCWSSPPVASAWPPPASARTNCAASGSGSCSAAVTSTWRVSAPCSAASRPLEAESFAGCPARHQAVRRQAFVEQLARAFHPRDRQALRVEQADLHQHAGLVPIDVLVVKAVAAKAHHAEHGDFHEAPGGWDAGQQPVDLAAVGEAHDELVDHLQRPHRPRNRREGHVRRVAVDEVMAVEAAQFALADAAGEGRDMVDVGLGDHGRHGRGDVAGIELVAHMLVPQRGEVEVRPDLPLQGGDAAFVSHQVGRFVEVHAADAGEGVIDAGVEVQLGLGQVAQAGQDRVAGLLRAVGVLFGEMQHQPALDLFRLVEQRLDAHAVVAHRAGDVGARRGEVGQLAAHAEADEADPGVDHLLALAQVLDTGGDVVHRGVQIDALEQLDGLGEGRFVVAQVDARLQPPEQVGDQGHVALFGVQVGHRAHVRVDAEDFLTDHHARPLAAGGEREIRVEPAAAVGRGDADVLSHAWIPHRVVVGVGKRESEANQPIRNRSAGHWLSACWREGIRIVRERGAGGGALLGEPLADTAQARWRCQGGPAANRASTHWRNALAAAVAYRAEGRTR

SEQ ID NO: 31035 - protein, 284 aa, Pseudomonas aeruginosa
PKVVFPYRQDSPNVRRQPGRPWSLWSPGSFRESPMTAPFKDHFSTGSANYAAHRPTYPAQLVDELAALCPGTRLALDCGCGTGQLTVLLAERFERVVGTDASAAQIDKAQARERVEYRVALAEDSGLAAASADLVTVAQAAHWLDLPRFYEEVRRVARADAILALVTYGVLHVDGPMEPLVQHFYHQVVGPYWPAERRHVEEGYRNLPFPFEERRLPDLAIEVAWTLDELLGYVGTWSAVKEAGKALGQDPGAAFVDELREAWGDPQTRYRVSWPLTVRAGVIR

SEQ ID NO: 31036 - protein, 279 aa, Pseudomonas aeruginosa
RVLFFFAVESFSVSGSLLVPASLASRIRLLLVMTRREVELRYRDAMLGRIWIIVSPFLLLLIYTFVFGFVLKSRWGGSQSTLSFALTLFSGLLLNGILAESLSRAPTIIQANANYVKKLVFPLEILPLTPLLAAFFNAMLGYLVLCIFLLFSGVEPGWQLVLLPLALLPFLLCVTGLAWFLAGLGVYVRDIGQFVQFLLVLLLFISPVFYPLSSLPPVMQPYLYLNPLTIPVEMVRAILFDAPYPTLGVFSVYCVASLLVCSSGFLWFRRVQEGFADVL

SEQ ID NO: 31037 - protein, 225 aa, Pseudomonas aeruginosa
TVISFDTRNPGLFLSGALDSSSAVPLPGSGRLVGALPGPGPARCGSARLRQRRHPLPAGAGGGGAGSRTRQQRDEPGHGKAFFGYSHRTPGVRLPYPLPRRRRPARPTEPSPRAIRGGRLADQADLRHRHRGATVAAGWTHEHPGQRYGARRAGLHLARGAWRIGGHAPVAEGARGVAPGPARDAPGPLAEDACMGSGTPRHHPGDRPHRIGQVHHALWRAGGNQ

SEQ ID NO: 31038 - protein, 204 aa, Pseudomonas aeruginosa
WRAQAHQRGRSRGIPGAQYHPGPGPCRHRPDLRCRLALDPAAGSRCDHDRGDTRPGDGGDRRTVLAHRSPGAFDPAYQRCGERLHAFDRHGRGTLPGGFAGARCPGPATGAQVVRPLRGTLRANPCCGRSGSDPGGHRAAVPGAGSAMARGARLRPLRRYRLQRPCGHLRTRRSVFRDARPDRAESFPRTDASACRQPGTAQSA

SEQ ID NO: 31039 - protein, 192 aa, Pseudomonas aeruginosa
GCRRPGRAGPRWTICSINCRPWAIACAAMGGSCSLVRAGRFPSSCCDCPMAGRLLLGRRYVTWQTEFAWAESCRSIMGARHIRCCFSPLSARPGRSADAGAAGRLHAPGGGGCADAPGSGRRCAFRLAQQCLSEHAAGRGGRAAHRDGPGGDGLSGAHEPCARTRRQGPAGALPAGVAKFAAVRVESGGGPP

SEQ ID NO: 31040 - protein, 198 aa, Pseudomonas aeruginosa
WTMIRSRRKQGAFTLLEMIVVLLVVSFIGTLLMQGLSYASKANQSLHQSLGRGQVRALTFDWFRDAVENLVAPEAGEVRWRLRGDELSFEAMSAAALDRRAGIPTPLAFRLERRAGEDRTELIYVRRLEDSRWPLLHLRGEARFRYLDGHGQWHRDWPPSAQLADTLPEAMALAAPEERLFVLVAVVLPRARPAEHDF

SEQ ID NO: 31041 - protein, 123 aa, Pseudomonas aeruginosa
TSAKFYFMVGLALRAGSSMLEHNFPMDTIAMKFLLPLLLLFPLSALADDKDYDQCILDYQRTAKSGVAVHFITQACDKLYNDGSFLLSREKAYYECLLENLPGVENNLAAQKIRSACESKSQN

SEQ ID NO: 31042 - protein, 168 aa, Pseudomonas aeruginosa
RSARKRPARTSSARSRLVAAIRRTSTRCSRSEPTRCNCPLCSTRSSLACTASGNSPTSSRNRLPPSASSNLPRRSLTAPEKAPRTWPNNSLSTRVSGSAAQLRLIIGLPLRMECRWMDCATSSLPTPVSPVISTLRSLLATRRISSSSALCAALWPIISRGRSPAASR

SEQ ID NO: 31043 - protein, 261 aa, Pseudomonas aeruginosa
ILVVCLGTLPEMLRGETKPCMRQESSMLSNAQRALIKATVPLLETGGEALITHFYRTMLGEYPEVRPLFNQAHQASGDQPRALANGVLMYARHIDQLQELGPLVAKVVNKHVSLQVLPEHYPIVGTCLLRAIREVLGEQIATDEVLEAWGAAYQQLADLLIEAEESVYAASAQADGGWRGVRRFRVARKQAESEEITSFYLEPVDGQPLLAFQPGQYIGLRLDIDGEEVRRNYSLFRCQQRPRIPHQRQARGGWTGLQLPA

SEQ ID NO: 31044 - protein, 123 aa, Pseudomonas aeruginosa
ERPVNLQTVESNTIDSHGEIPMKKLTALFAATAIALTAGLAQARDLGPDEALKLRDAGTIKSFEELNKNAIAKHPGSSVHDTELEEEYGRYIYQVELRDPQGVKWDLELDAATGAVLKDHQDD

SEQ ID NO: 31045 - protein, 661 aa, Pseudomonas aeruginosa
GSRSPGRRTDGQPDPPGLRGGLAGRRPRRGGAGRQRALRSDHPRPRLARASRPGDTPGVAWAGTRDSGADPHRARFLGRTHRWAQGRCRRLPDQAVPSGRAGLAHPGPVAPRPWAGQPEPAGGRRAAPGRAAPVRVPERRRRRPDRRRIPPAALFHAAPRPGPVQGAPGRASVRRRDRTRFPRHRGPRQPPTAQARPRGDRDPPWPGLPLRRGGRRMRSIQRRMSVGLFAVLLVVGLVLAQTGLWLFDQGLRRYFAGNLREEAENLLVAMVRGPNGMQLDEQRLNPAFQRPYSGRYFVIELEKDTWRSRSLWDSELEVPHKKGLVQGLVDGPEEQRLLVFRGHYKRMGQKLRIVVAQDYTPILESFARVQWMGLGAGALALLLVLLLQRLTVRRSLRPLEEVRLQIAQLQQGQRSQLDNQAPEELEPLVEQINHLLAHTEETLKRSRNALGNLGHALKTPLAVLVSLAEREEMARQPELQQVLREQLEQIQQRLGRELGKARLVGEALPGAHFDCAEELPSLCDTLRLIHGPHLQVSWSAPPGLRLPWDREDLLEMLGNLLDNACKWADSEVRLTVAQGEGMVRLKVDDDGPGILPDQRQAVLERGTRLDEQVSGHGLGLGIARDIAEACGGRLSLEDSPLGGLRVSVELPLQKSGRAARA

SEQ ID NO: 31046 - protein, 113 aa, Pseudomonas aeruginosa
HPGLLARRSWTMKRRTSTGRWRWALMLPVLVFLLGESSGQREEGRSPRLPAQARYEQAVENALRSERGEPRQAGTAAAKVAEAGAPARLRGWLRSLARLAIWGTYGPPALFRP

SEQ ID NO: 31047 - protein, 291 aa, Pseudomonas aeruginosa
NPAGQRGAQRRRRQRDQRHPRHVHPSPGHARRVAHRGAVQLPPQARLRLAADRAGRTRRCQLQPEEPGGGRGIHRRRVRRTAVAGLDDHRRAGRFRGLLAVRRGALEGDRRPVHRRHEDDGHHRFHHDRRGRFRRGDEGHRRGAEPGRRLGGLDRQQQGGRRHADAAGRPAGHHGHRLVVLHRADHRRDLRPAGGATGLQPAGHRQHRRHRRRAGGCRFSGVGLDPWADLRAQRRRPAQSHLGHRGADLPALQPAVAGVRLGRRDVALSSISGGRLTECRAGRLSFRRDCR

SEQ ID NO: 31048 - protein, 563 aa, Pseudomonas aeruginosa
ELMMRLTLKSKVLLLAMVPVLLFALVLSGGAVLILKKQADAEVKDTRERLLGDRRAELEHYVQIAMGSIQAEYDRSANGDLNARAEAIARLSKIKYGKDGYIFGYDSQVVRLFRGDSPVDVGKSFRDRRDPSGVYLNRELVEAGRNGSHYVTYTSPLPGNESVMVPKLSYTLYLPKWDMVIGSAINLDGVEAQLVEIKQDIDERIGTLIASIVGIAGVLLVVLLVIGLAVANAMLRPLHQIRQNLDDIAAGEGDLTRRLPVTSHDELGELAGSFNRFVEKIHGLVRQIAGMTGDLKQLVEQMSAQAERSEQAMERQRHETDQVATAINEMSAAAHEVAQSAQRAAEAAQQTDHEGQAAKRVVDGSIERIHALVDEIRDSGTSLDSLQQDVQSIVSVLGVIRSIAEQTNLLALNAAIEAARAGEAGRGFAVVADEVRALASRTQQSTQEIQGMIDRLQQGTNAAVDAMRRSGEAGEGTSNQANQAGDSLDAIAQLIATINAMNAQIASAAEEQTAVAEEINRSVHQIAGAVDSVADEAQQGAQTARSLAQLGQGLGRLVGQFRI

SEQ ID NO: 31049 - protein, 204 aa, Pseudomonas aeruginosa
LMLCFPLPDGLDMLDTKLESRTFLLLLAVVTLAFGWLLLPFYGAVFWGTILAIIFAPVQRRLQVRLRDRKNLAALITLLICVLIVIIPVIFIAGSLVQEGASVYQRVKSGELNFAAYLQQAVAALPPSVHQWVGALRPGPISRACRRSSPRWRCRPARWWRPRRSASARTPSTSSSASASCSTCCSSSSATVACSAGGSSRRCR

SEQ ID NO: 31050 - protein, 175 aa, Pseudomonas aeruginosa
RSATDASVPAAGSARHAPGHRSPAPPACRRPGPLRCGAPHGGSRSARAARCRPGLSALVAPAGGCCGRPHGCRTIASPGVPGRWRCTSNRPSSRESAADRPGGPAWRPCGGDSGPVPGAPRCAGRPPAGRCRRAGRSRARPCAPAPPAPPGSARHSAQGPPMAWRYSPASSPPSA

SEQ ID NO: 31051 - protein, 176 aa, Pseudomonas aeruginosa
MRVFLPSSELCPHSAMRKYIGTSIISQKKKNRNRSMARNTPITPPRIHSRFRWKKPMRRWISFQEQRTESTPSRPVRATISSDRPSIARWMLMPRRSIHSTLNCRVHSGSPPGAGASWKSPVAQIQRLRIRTRVIESSAIQRGRVLLLCSAIQQRKPPMKGIRISQGRIMTGSVSP

SEQ ID NO: 31052 - protein, 323 aa, Pseudomonas aeruginosa
EVEGSSAHLAGSVDIEGVEAAIQLQQDRQADARFGGREAQHQDEHHLAVGLAPAAAGDHEGEGGGVHHHFQAHQYEQDVASHHQADQSEGEQDAGEGQAVFQWYCVHSVTFPWGGRRAPAEPLLFGVLTTQVIGSDQGREQQHGGQFDHQQVRAVEADADRLGVYRGMADAGTARGAGEDHQQFHQQDQGQGRRPDPDAGREPLALLLDHGRAEVEHHHHEDEQNHDGASVDDDLQGTGEGCAEAEEGHRDGQQGNDQVEQGMHRVAVGDDPQRGQYGDAGSEIESEFHATSPYGSRLFTLIGSASFCAAPFGLPAIAIPATR

SEQ ID NO: 31053 - protein, 926 aa, Pseudomonas aeruginosa
PERESANSLCSLLQTFHGAAGDRRRDAGEADRQADQAGAELFIDTQRQAQGLALELEAEGRAVVDAEAVRVFLGQGDVGLRDALLDRRGPRAVFLAAEQVVQRHYLPAVGLGAERHRHGLEPVEAFALRFDQAHAGVAGAQVAADLVLELVPGLRRVPARRPGERDLLTVFLAAGVAFHGEGERRVDVLRGARLVHADIGAHGGAPAVPVRFAGQLEALDAERGGRCGVADAGQDRLCLGHGFGDVVQLGPVDALALQGAVDRMQPAPALADHVPGVVVGRVEHLEEALGAAFLADQGAVAFGEAGRRQHQVRLGGGGGLLVIGDDHHLGRRQGRVDTGGVGAAIEIVLQHHHGVGLSGGQSLERGFHGVAAEERQAEAVGFADHQADGTVLLALLEGLGDVRRGFDQCLVAQRVAGHYQRTLGRQQGIGDALGEGLGLRVEVGHGRGAWVDRVGHGEAEASEIVRRGVNGFLGHVVEAGRADAGDEQRVLRMLGDVLHRGVEPRLDLHVGSHLDGLALHRLAQGQGDAGGGLGQVLAEDEDRVVVLDVADARHRQRAFLHDLQDQAQAVELAFVDAAVEVAFANQLAQGEVAFQAGARRTDADHLALLQQGGGLVEGAVQAQLLLAQHQQRLARTVFAVDVAVAEATAVAEEVVVDRAVVAVLDAADLAVALAGADVAAAGAAVADARGELHVPLAVVALGVGLVGEHAGGADLGEVAGELAFQHAVLDPSEVDVVVGAVDAEVGAAGVVLVVAHAAVAGDAAVHLMGDERAEFLVLVGALGEAVPALVVAGHHRHVLQVAVTAFLAHRAVVRVVGHQPFDDAGAELLGLFVFDGDPGVVGGGGHAGHDEATTLVVLVGVLLHRALAAGADATERRVPAEVGNVETEGQTGLQEVVCTIDFERLAVYVDSGHGSSLRWPVVSGRG

SEQ ID NO: 31054 - protein, 191 aa, Pseudomonas aeruginosa
KLTVPSGLRPGRGTTTKHRRTAGRPAAKHQAPTVAGRGAAEGWREMPASNSARKYLRALPSGSTAPGAWAQKVLPGPRKLTSCSRVSRSPGWPSPRSRARSSFTLHGRPSRQGVHQPQDSRAKNSSMLRSRETMLMLSSTAMARPVPIRVPTLAMPPANICASRCSGSRKPVPAPPGCQALSWKPSRMPPA

SEQ ID NO: 31055 - protein, 73 aa, Pseudomonas aeruginosa
CGGPPAGGISDYRRWRRLRRRWPGSPAPRRSPGWRRPAPSRAVSGRSSGLRWTPRAGPRSDAFHARWTSARFR

SEQ ID NO: 31056 - protein, 180 aa, Pseudomonas aeruginosa
KVRPGGAFSGAFRRGGCPAGGSGWRRKSGRRRAATCGWAVRPSAARRSPRRKRWPCRRSVRSLPGRPGHRPATWSVGRGWRTVRRRAAGAVPGRSAAARPRPAARRRTGCRTGRSRTRCDRLARCRSFRGSRRRRRQPSGWRRCRPGRSAPLPRRWAWPPAARRGSRPGWRPSCGGSAAP

SEQ ID NO: 31057 - protein, 82 aa, Pseudomonas aeruginosa
SRNALNLISRLQRMSGFGVRPALYSARKCSNTLSQYSAAKFAVCSLMPIRSQTAWASARSSRAVQYSVPSSSSQFFMNRPST

SEQ ID NO: 31058 - protein, 755 aa, Pseudomonas aeruginosa
AQGFCFVSVTPSGQAVDRRVEGGAGAHHLAGQLRVGAIVAADLGRLALDRIEFGDDGRFLLGQGLGQRCEVRFQLSVFVLGGQGLGPVHRQVEVAAAVVDVADLARRRLVVVQQLAGGFVQRLAEQLGLGVAGLDPGFLQGHGQGQELAQGVPAQVVLFHQLLDVLGCRAAGAGFVHAAARHQRNDGEHLGRGAQFHDREQVGQVVAQDVAGHRDGVLAADQAFHADANGLVVAHDADVETGQVVVLEVQLDLLAQFAVVGALRVQPEDRRGIGLACAGDGQLDPVADRCVLGLAGAPDVAGLHVVLHQHAAVGQDHAHGAVGGHFEGLVVGAVFLGLLRHQADVRHAAHGGRVEGAVGLAEVDHLLVDAGVGAFRHYRLGVFLLAVLAPHLAGVADHRRHRGVDDDVARNVQVGDAFHGVDHRHFRAVAVHLVDVVEDLFLLGGGQRLDLVVDAGDTVVRVHAELFEELAPLVEDVLVVDAHRMSEDDRVGNLHHGRLDVQGPHDAGFLAVLQGLLEEVAQLAAAHEHAVEHFAFLQAQLLLDLDLAVLADEFDAHVTGLGHGDGLFAGEEVAAAHVVGVGARGHAPLAHGVRVLAGVGLHCGRRATVGIAFAQDRVHGAAEDLRVACANLFLFVGLRVFREVGNLVAQALQLGDRAFQLGHRGADVGQLDDIGVGRGGQGRQAGEVVFDTLVGFEAVGEVGQDASCKRDVAGLDVDAGGSGKGLDDGEERVGGERGCFVGEGVGDLRADGHLR

SEQ ID NO: 31059 - protein, 172 aa, Pseudomonas aeruginosa
PGHLAAPGNPGRRTRLRGFHQGPADHPGRWRHPLPERGPAPATRSLRLPAPGTLVRRRAQPGEEARRRGHGDLPRELRGHLCRRRVEGRFAGSGEGHQVPHRGNGRQEDPLHRELRHRHQAGFPGRHQAPGAQGPAIRRRQRPQFGDPGAQGQHHEVHRGCLQGLGLRSRAR

SEQ ID NO: 31060 - protein, 139 aa, Pseudomonas aeruginosa
IRRRAAGRRSVDAVQESEDRQERRGQGRDRRRHVAADPAAPRRVRRDRHPEPERRLSLRRPGGRGRWHRHRARRQPVRFGGHVRGDPRHRAEVRRPGQGQPGFADPLRGDDAAPHGLDRGGRPDHQGHQRGDRRQDRDL

SEQ ID NO: 31061 - protein, 593 aa, Pseudomonas aeruginosa
SRAGGADPCPPAQEQPAAGRRGGGRQDGHRRGPGQTHRRWPGAGPAGRQRGLLPRPGCLARGYQVPRRLREALQGLAQRVAQAPARGAVHRRDPYHHRRRCGIRRGNGRLQPAQAGSVLGRDPLHRLDHLPGVPRHLREGPGLGAALPEGRRDRAVGGRHLWHPQGPQGALRAASPHRVQRRGAARRGRAGGALHQRPAHAGQGHRRHRRGGRLPAPAAGREAREAHRGGAGRGYRGEDRADPAETRHHLRQGVAAQPRARPQADRVRPGRRHRVAVHGDQAVPGRAQGAGQAGRLVPLRRSHRRGQDRGGAAVGEGLGRGAGALRHVRVHGAAYRVAADRCASGLRRLRPGRPAHRGDHQDPALRVAARRDREGSPGGLQPAAAGDGPRHPDRQQRAQGGLPQHHPDHDHQRRRGSGGARVDRLQPAGSHHRCDGSDQEELHPGVPQPPGYHHPVRPPEHRDDQERGRQVPHRAAGAAGGQARPARGQRCGARLAGGEGLRRADGCATDGAAYPGQDQAAVGRGDPVRRAGRAWRPGACRPEGRRAGLRVRDHGGGARLIRARQRKRPADAGRFLLQSASRSGSCRLSGRGR

SEQ ID NO: 31062 - protein, 535 aa, Pseudomonas aeruginosa
EVGREKRRALCQKIDNSATRLSGEGDPALVDEQFDGPVLGLVVHLAAILDPVAQVDGLQAQAFGLGDLPEDRVASQAALLFVGIVEGIDGRESVRQHVRHGYGQQAAMQAELEEAAEGQVADQEGGELVAAGRIHVAVGVALLDVAPIEVVVLLVEARSLADHLQFRIALEDAPLLAVRAEAGDRYARGDAGGAMLAVRTIEMVAAAAEADLRQRGVQLRVHGLAGIEEQGGCLLIGQVAARVRLRRVELQSGEFGHGELQQGPISKFMPGTETRLKIQVAGRRLVAIALQVVGEFPPADGAGAQAVQVAGRHLAVDEDEAGVAQMADQRDEADLGSVVGAAEHRFAEEQPAHGQAVEAADQLSLLPDFHGVGDAAQVQLLVGQLHRRGDPGAVGVVTRRGTSLDHRPEVTVESDFEALLAQALGQAAGNVQFVGEQDGARVGRPPEDRLAILVPGEAAVAIGCDQALRIEVAAGREQPVGLLQGLVEGRKVEVGAGKPGQHGGVGEGGPPPGPINGRRGIFRHPARPCSRRRRK

SEQ ID NO: 31063 - protein, 221 aa, Pseudomonas aeruginosa
RRWRRPAPRPGWCSSAGARCRSRPCRTACPGGSSPSAACRDGGSGGLPWRCWPGTALPRRRYCRRRPRRPPGCGRKTVAGGAGGNALAHEGFFRRHAQVLRGGTGGNDQCIAGISATIALQCEGALLQLGGVDVVVDDLGVETLGVLLHAGHQRRAGKAFDVARPVVDFGGGGQLAAWLDAGDHHWLEIGACGVHGGGIAGRTGAQDDEARMLDFTHKKTP

SEQ ID NO: 31064 - protein, 130 aa, Pseudomonas aeruginosa
SRPTSRPGSPSRSPARSTRAPSSTRVAPNNFSATATCSTCRRAQACRFACTAPSFPTTRCTGWSRPGSCAARPTTSRTSSLASTKAAAVAVPSMAATAPAKAARTTRSTTRRYVSSPRVAGHRSPPCNAS

SEQ ID NO: 31065 - protein, 211 aa, Pseudomonas aeruginosa
RIPMRLIRTLFVAALAMGASLAHADDSAAVQRLTGLLNKAQTLTARFSQLTLDGSGTRLQETAGQLSLKRPGLFRWHTDAPNEQLLISNGEKVWLYDPDLEQVTIQKLDQRLTQTPALLLSGDISKISESFAITYKEGGNVVDFVLKPKTKDTLFDTLRLSFRSGKVNDMQMIDGVGQRTNILFFDVKMNEALDAKQFTFDVPPGVDVIQE

SEQ ID NO: 31066 - protein, 444 aa, Pseudomonas aeruginosa
AQAVDLFRSEPVAQPLAARLRPANLDEYVGQEHLLARGKPLREALEQGALHSMIFWGPPGVGKTTLARLLAQVSDAHFETISAVLSGVKEIRQAVEVAKQHAAQYGRRTILFVDEVHRFNKSQQDAFLPYVEDGTLIFIGATTENPSFELNNALLSRARVYVLKSLDEAALRKLVGRALNEDKGLGKRKLRLPEESFQVLLAAADGDGRRLLNLLENAADLAEDGSEISPELLQNLLGDTRRRFDKGGEAFYDQISALHKSVRGSNPDAALYWFARMLDGGCDPLYIARRVVRMASEEVGNADPRALGLCLSAWDVQERLGSPEGELAVAQAIVYLACAPKSNAVYSAFNAAMRDVAESGSREVPLHLRNAPTKLMKSLGYGEEYRYAHDEPDAYAAGEDYFPEDLEPRRYYQPVPRGLELKIRDKLEHLAELDRTSPRQRRKS

SEQ ID NO: 31067 - protein, 211 aa, Pseudomonas aeruginosa
SSAKSCNCATSWPGSKAPARTPEPSAFSPDALAGKSFPAWCARQVETRAQRYYPGRVDGAVAGVLVPLDMFEVHCLADARALVQLAQPAGEIRVVFDAPQVALEVSVVHRIEAHQGGEQADIGLGQVFAGQVAAFAEQAFQVVQLLEQLDEGLLVGVLASGEASTVHAVVDRRIDASVEAFDLLAQRLRVEVQRVGADGVEGAVEDADDIG

SEQ ID NO: 31068 - protein, 149 aa, Pseudomonas aeruginosa
FVVDDLLRLLVPQQRHRDPAAVVRVVAGVSLVQKGQAVEAIAGGAVGGVEGPAVLAHQPTDHRNIDQRLQPLQLAHDQGPMGPGAGQRDIEMVAPALGGERRLAQPMAALGVFALEAAVFLCVIPLVVPAAIDQLSHERVPPYVVGGTV

SEQ ID NO: 31069 - protein, 286 aa, Pseudomonas aeruginosa
SAARGGRRGSGEGRIGRWRISCCDTRRISSNDKPMPVFCRSANEKARRGDGLFRRRFLSVVAAGDAEDLQQADEQVVDRHVQADGGHDVVAFAAVDDRAGLVEDHRRGEQDEAGADRQLQATDLEEQRYQHGAQQDEEAGGDEAGQEAHVLAGGQHIGGQAEEHQGGHGERRSDDAAAVGQAEVHVEDRAERVAHEAGQGESADQTPGAVAQLHGEEEQAVEADQHHEHVRIGQAHLLRNVGHQAAEGQGECQQAVGIAQNAADFTLFRDGGVQLILLFLHGVGTP

SEQ ID NO: 31070 - protein, 141 aa, Pseudomonas aeruginosa
PASVQPMVPLRNAATGLGMPALSSDWVPMMLRVRPAQLTITRVRGSGASSATRSTSSAPGTLMPPGILMVWYSSKRRASRITASALASSKACTSSAASDGVWRSASTSSPKALLGTFTSLNSSPPALRQPDRPPSSKATSL

SEQ ID NO: 31071 - protein, 188 aa, Pseudomonas aeruginosa
SVVVTTRTSRAMATTSTMTAATPVPTNTCKPCVLSGPPRDRWISTASSTASRAPRQRCARASRRTYRSISVAPPTQPSRSPPGTPTPTCSGASRWPRSTGISAECAPPPRPRDAIRASRCHSGRSSRIPRRPPGSVPPRCSNRSARTVRASVCRCATTSRRTSVRSACWPPPSRARCSTAVCGPAWPG

SEQ ID NO: 31072 - protein, 174 aa, Pseudomonas aeruginosa
SAIAWPRRPSRRSDLSSTSLTSPLSHAPTKRPASIESWSATGRTSRMDSWWPPPLAWPLPGSVCCWRTAPVSSPRPWPRASWRPSNTSSTGAWRCISSAAAATPTSARTAIISTTTSAMPAATNSSNCSSAPGPAPNPSISTARTTAWSTPSRPSVRSRNRTFRCISAAPRKPR

SEQ ID NO: 31073 - protein, 158 aa, Pseudomonas aeruginosa
RSPASRPMCSCSGANPWHRPPKPSPLCANRRARMVAKWSSACRSGPSSGARRTRPGPRPRRYAQAPARAWARPASPRASRRASAPSVCSRRWSRASASTSAFGPESPGWSVAGTTPPPWSVPRNRWPTPCSPTTTWACAISSFAVSIPSPMPWNMAAS

SEQ ID NO: 31074 - protein, 387 aa, Pseudomonas aeruginosa
PAPKSPSASAGAPRPDPMAVLQTPSAAFDEWLPELTRQLAESADAHDRSGDFPHANLALLRHHGLLALALPPALGGPGASLGELRRVIGAVARGEPSTALVLCMQYLHLRRLADNPDWPGALKRRVAREVLEQGALINSLRVEPELGSPSRGGLPGTLARRVGDGWQLSGHKLYTTGIPGLTWLAVWARSDEPIPRVGTWLVRRDSPGIRIVESWDHLGMRASGSHEVLFEEVAVPLENAIGLHPHDQPPAPDQAVLRDFAQASAVLLGALYDGIAGSAREWLVGWLRERVPASLGAPLASLPRMQEALGEIDGLLLQNRLLLDAACCGQLPASDSGLLKVAVIDNALAVVEEALELSGNHGLSRHNPLQRHYRDVLCGRVHTPQER

SEQ ID NO: 31075 - protein, 343 aa, Pseudomonas aeruginosa
PRIAPAPCGAAWRLPMKRPLCVLAGLLAATLLAGAASAADLISLRLGDVKGDRYAALRASGELDDLPYKLEMSAFPSGAPVLEALNAGALDIGFTGDIPFLFVYAAGAPLKAVGAWHFNPATVALVVGKDSPIRSVAGLKGKRIAVNRGGWGHFLALGALRRAGLGPQDVSFSFLGPVDGRAALVRGSVDAWVPWEPYTSSAVLLDQARVIDNGAGIMTGYSYALASDAAIARKKAAISDLLTRLARAQAWALRHPEAFAEALAKDLNMPREVTRRWVGEARISPVVFGPEVAATLQTAADFFHAEGVLPKSLEVAPAFDFSLSAGAAEVARQLPADLRVGQR

SEQ ID NO: 31076 - protein, 274 aa, Pseudomonas aeruginosa
SQRSSCVDIALHGGAWHESLGKLLEALDRPFFWRILAQTLGQFAPVDNWAALIFSDSSPLILSFMEEEREEVEPDPLISRYITGLYLQDPFYQVSRNCRRGGLFHLADIVSEDFETTEYYNTYFAHYVVTDEVQYNVPLDGERTLCLSLGSESRFGAEQIALFELLRPWVIALMKKRIHFEDAVREEAKPIAAAEVEVQPWRGLISPLTARESDVIRLMLDGYSNKEIADRLTLSIATIKVHRRHIYAKLNVKSHSEIFALLINPPAPRLADAR

SEQ ID NO: 31077 - protein, 158 aa, Pseudomonas aeruginosa
STSSSSPPTAAGRRPLTSGRPATATASPMAAGGTSGWPSAIAASSTSPPNIASRSARCAAASMSAPVGATIFPWAIPRSTGNRWRSTRVSGWATISRCTASAPIPGARPPRRPTIAWLRWRRRCIRTASRRARTATRTTMRSSPGCTASVCWMPGTGT

SEQ ID NO: 31078 - protein, 475 aa, Pseudomonas aeruginosa
TRRSTVKPATAREASTWRATATANGPATWTWGENSNWISSLLRRALSLGCGIPAGKLPHRRPRTGVLLQRRGGIPGWPLAAQRGAMVAARLGVLPGPGYLPDPSLGGRRGGAPREIQRLRQHHQRQVRHPLPVRSAGGAARQRKQRVPRAVPGPGALHRPQRRPDHRPWPAGGQLAGGEDARRRRTATGEVDQLQPWPGTQPVGKRRAEHRRLPDQHPRPHRRQRHLFRPGSHRCPGRGGDLVAGQCQYGQYPLPGQRCRHPHPRCRHHRSLPRRAWRVRAGRLGTVGQLQPHHLAQEPSRRQRRAAAQCPAGRLDHQLHPAQPGFPRRHLEPPGLGGQPAPDALRPDQLGTRLHGRAGRLVDGEIQPFRQRPEVHHRHRRALPAQRRPDADRRRRQPVRRPSGQAARAEHHLWRRAALRHLCLADRLQRRLLLPTRGIPLLEGQAWRNENFPRPAAVCCWRRWWRSCSGPPASC

SEQ ID NO: 31079 - protein, 196 aa, Pseudomonas aeruginosa
ADRRRPRPGAAPVSGWCWATQVLAVFVMSGIMTHGVPMLVERGLSRGEAGTALSALWVGMMLSQPLMGWLLDRVATPRVALPFALAAVLGMAWFLVGDTPSGLWLAVFLVGLGGGGESGTTKYLLMRYFGLRSFGVIYGSIQPFTFALSISLGAYLLGWLYDRAEGYGTAEWVLLAAFSLAACSLFAFRPYPQKLP

SEQ ID NO: 31080 - protein, 402 aa, Pseudomonas aeruginosa
LLLSRSVRGVPQHLSRFRPLPAIQPRARLLSGRKIRSGSVIGWSSSNMTSRAGLSCRLPSGPLSINRCGDRERKALGGGPVSSCLAFQGNRQAPGQVFHACFAEYLGFHRLDPREHLAARFIQPWLLAIDEPFRQLHGRGPHEDLDILQGALDVLRVHGLAGLPVIAHGRGLQVEPIAEQDLPRLNGEGQRGIGVGYLRLQLDGGDILDLRAFGPTGIRDHFPLAVLLLGPAHALAGGHVHGAADILCVGFVCIGGVAPVVLLHEPAIQHGGQVHRTKWAGSRLPLWRLDLGKGAVDLVVDPSGQQVGSRRDDVDLEEVPQIDGFLDLLQVVVGKGLHVGDPGHVLVLEYDPMRVAGEVRHALVGHERRYQHHGHAFAGSLIDHVQELVGGILLGAAESGVA

SEQ ID NO: 31081 - protein, 238 aa, Pseudomonas aeruginosa
VRIKSVLPPYDFFRSLRLSNLPLSSTRDRQASPLRFQHVRNTMKNILLLNGGKRFAHSDGRLNQTLHETALAHLDRRGFDLRQTFIDGGYDIPTEVDKFLWADVVIYQMPGWWMGAPWTVKRYIDEVFTAGHGSLYANDGRTRSDSTQKYGSGGLVQGKRYMISATWNAPRQAFDDSSDFFEGKGVDAVYFPFHKANQFLGMSGLPTFLAVDVMKRPDVPATVAAYQAHLDRVFGRAG

SEQ ID NO: 31082 - protein, 321 aa, Pseudomonas aeruginosa
NERASTVSKPPPTTLPAGRSSISDACRRIQEIHMCPCPHSQAQGETDGEAEWHNAALDFTHAMSYGDYLKLDKVLDAQFPLSPDHNEMLFIIQHQTSELWMKLMLHELRAAREHVKSGKLGPALKMLARVSRIFDQLVHAWAVLATMTPTEYNTIRPYLGQSSGFQSYQYREIEFILGNKNATLLKPHAHRAELLAALEQALHTPSLYDEAIRLMAAQGLPVSQERLARDAAAGTCYEASVEAAWRQVYQAPERYWDLYQLAEKLIDLEDSFRQWRFRHVTTVERIIGFKPGTGGTEGVGYLRSMLDTILFPELWRLRSNL

SEQ ID NO: 31083 - protein, 197 aa, Pseudomonas aeruginosa
PGHPGKRSRAGAAAVAGGFPRGLHASARGSADAAGRGRPIAPAPFPWRTSVAGLGSVPAGTGRVAIPGRNPCRVWACGVPRSGHRGEPAFNRGLLDDGGVGFRVAVDPVQQRVELFHRTNLEAGDEAVVTGDLVALGELGDVLDLSLDLVQPAGQGADAHDRLELVAETAGVDIQGVAADHAAFFQLAQAFGDARGR

SEQ ID NO: 31084 - protein, 321 aa, Pseudomonas aeruginosa
VMRWRAGRRLWIIIGLSCGRAPMNDPIRRGTLEMTSAMLICGTIGWLVLLSGQPVLDVVFWRCVFGFATLLVACAALGFLRRGSLGREAFLLALLSGVFIVGNWVLLFASYSRASIAIGTAVYNVQPFMLVGLGAAFLGEKVTARKLGWLGLSFAGMLAIVSAHGDSDAPRGDYLFGILLALAAALLYAFAALIVKRLQGTPPHLIALIQVGTGVLMLAPLANLAELPRDVAPWASLATLGIVHTGLMYVLLYGAIQKLPTALTGALSFIYPVAAILVDWLVFEHRLSLAQWLGVAAILLAAAGMQQGWSVRLPRPAVRRG

SEQ ID NO: 31085 - protein, 396 aa, Pseudomonas aeruginosa
WFDCRIVGQKLERTMFENFSPSTMLAIKKYAYWLWLLLALSMPFNYWMAQDSAHPAFWAFSLVIAVFGIGPLLDMLFGRDPANPDEETQTPQLLGQGYYVLLTLATVPVLIGTLVWAAGVFVAFQEWGWLGRLGWILSMGTVMGAVGIVVAHELIHKDSALEQAAGGILLAAVCYAGFKVEHVRGHHVHVSTPEDASSARFGQSVYQFLPHAYKYNFLNAWRLEAVRLRKKGLPVFGWQNELIWWYLLSLALLVGFGWAFGWLGMVFFLGQAFVAVTLLEIINYVEHYGLHRRKGEDGRYERTNHTHSWNSNFVFTNLVLFHLQRHSDHHAFAKRPYQVLRHYDDSPQMPSGYAGMVVLALIPPLWRAVMDPKVRAYYAGEEFQLTAEQSERPAAS

SEQ ID NO: 31086 - protein, 545 aa, Pseudomonas aeruginosa
RYLGTERSPGMNIRQRILASGAIGIVAVVLLGGVGFWGQLRLGKALSENELSVNALRNHMEGDMMHDALRADVLAAFVVQPGDGAAAEQVRQDLQEHSQWFRKVVEQNQGLPLNDAIHQALVELRPDLEAYIGAAESIVGKALLDPVAARAELPQFVQAFKELEGRNEALSSLIEKHVEQTNRAREDSMRYSAWMLAGGILVACLVLGQLCRQLLRAVLKPLRKLVASARVIAQGNLQEPIGVDSDDEAGQLQRALGEMQENLRQMITIIRQESEELHDTSQSIGQTSQSIVDGASQQADSATSMAASMEEMITNISQISDHADNARVISAKSEELASSGGQVILNVVEGMSRIADVVNQSSTSITALGQSSDEIHSIIQVIKGIAEQTNLLALNAAIEAARAGEAGRGFAVVADEVRGLAARTTQSTQEITAMIERIRASTGQAINSMEAGVSRVNEGVSFARQAGVSINEILDGTRHAASVVDEISQTIREQSRASDEIAQRVELIAQRSQQNTQAMHEMAATARRLNEVAATMRSSVERFKI

SEQ ID NO: 31087 - protein, 485 aa, Pseudomonas aeruginosa
ILQASIVRVWPGRGRMHAAAGRAEVRIMETLPIRNRRLLVIDERQADRDRVCGLLQGTLGAESPPVAPERGYQVDTAGSAEEALGRIRSALQADAPYAVVFLGMPSVGADIPVLERFWRLDSRLQVVVHAPPADFPLLAPWAAEERLLLLGLPLQGQEVRQMAGNLSAKWNVTAHLQLQMSRMEAAIQEITREVGQAKEALEKEIGERKELESQLVQTEKLASIGHLAAGVAHEINNPISYVSSNYTTLEEHVRRLLEVLEAYEEARPAIRDEALARRLEQLGERVELAFVKEDVAVLLRESREGIGRVRKIVQDLKNFSRVDAEDDWQWTDLHQGIESTLNIVASELKYRADVVREYGDLPEVKCLPSQINQVVMNLVMNAAQAMGPERGRIVIRTGHTVEHAWIEVEDSGQGISPEILPRIFDPFFTTKPVGKGTGLGLSLSYGIVQKHGGTIEVRSQPGVGSAFRIVLPLESPGNLGGAHGN

SEQ ID NO: 31088 - protein, 118 aa, Pseudomonas aeruginosa
TVPKPMPCRLSLVVFPALFSIAAGAAEELKDMAGSTIVVAGRLEAVECPGAGLYDCTGWPANLYRFEGQDVCLSIEAGCDYSCDGILSEKGGTQSILVSGSYRDHIRKVEGTQVSCPR

SEQ ID NO: 31089 - protein, 89 aa, Pseudomonas aeruginosa
TDSSYIGQHHRSLKRSHMLPPRKDMSDTLSFASRLCKFVILLIGGASLFLWWLGRPYQDAMSAFVPLLMPMLFLVLAFDTFRAFSRPGR

SEQ ID NO: 31090 - protein, 183 aa, Pseudomonas aeruginosa
AIEGSSSHGENIIMFNTRSVLALVVSLSLIGGTPAVLADPGNGKGNPHGNQMDGGKGNKGNKGNQGGHDNHGGPGNKGGGAGQKGNGGGNWDSGPRIDVGGVRVILGDNRGYWNPGPALPPGIQKNLARGKPLPPGIAKKLDDRLLGRLPHYDGYEWMQAGTDLLLVAVATGLIYEVLDNVLD

SEQ ID NO: 31091 - protein, 542 aa, Pseudomonas aeruginosa
PPVGAADNRVAVVRLTSWKSFSYPRSGPQALQGIAQLRGEAVEIAAGGFGLLHLFLVAGGDRGDFREVAGNVLGHGGLFLGGGSDLAVHVADRFDRGGDLAQHGAGVGNLLGTGLAARLPAFDGARGIHRAVLHGIDDLVDLGDGLGGALRQGADLVGDHREATAGIAGAGGFDGRVESEQVGLLGDATDHVEDLADPAAIAFQLADDLHRMVDLLAHLADAANRFFHHVFAALGGIVRLVGGPGRVAGVARHFLGGGGHFLHRRGDLVGAAELLAGTGRHQAGDRVQRAAGAVQVAGTAPQPVEDVHQEVAQGVGGQGQLAEFVLAPDLDALAEVAMAELGDVLDQALHRTDQVAVDQPQAEQGDGQAGADQHQAAEQHGAPGLRADGGGMEITGLVQFVAQGLHLRGGGTVDAGHRLVAGDGVGARLEEPLPALSVSRTESPVLFAQALDTILQLAFGHAAQAPEDVLHRSLLGFELAPVFRLGLCLASAQQDVLPFLDLAAELQVGLVDQLRRPHGAAEQLAVGAYVAGQRAEAGQGYE

SEQ ID NO: 31092 - protein, 96 aa, Pseudomonas aeruginosa
LMDVPPTVQDEQAVSRQLHSLSVRNLAHLAAALTQLGFELSRSSDPGTRQAANAFIGQLANINQDIDRQIELLSALDADNVGFRLLDEVQYPDAPE

SEQ ID NO: 31093 - protein, 527 aa, Pseudomonas aeruginosa
RPGGAGRRFSDIPRTTTTRESHESAELYLGSPGCRLAGDHRRRRLRCHRRASCRARGAGGAASTPALQLAATGGAGRCLRPRLHRPGPAPRRTPGDLGAELRRMVHYPVRQRQGRCGPGEHQPGIPQQRAGIRSQAVRLQLADLRRRLQDQRLPRDARRPAAGAGAGASGRTGQRAPAGTARRDQPGRAGAGGLPALAGPAGAGRRGRRRGTAPAPGLAAVRRADQHPVHLRYHRLPQGRHPQPLQHPQQRLHGRRKPRTRRGRPPGDPGAAVSLLRHGDGQPRLRHPRLDHDLPGAQLRRRGDPAGRGRGARHRAVRGTDHVHRRAGSSAPPRIRPFQPAHRNHGRRHLPDRGDAAGHWRHAHGRGADRLRHDRDQSGVAADRSGRWPGAARDHCRTHPAEAGEQDRRPDGQGGAARRDRRAVHPRLQRDARLLERPPGHRRGHRPGALDAHRRPGGDGRRRLRADRRAQQGHDHPRRREHLSARTGGVLLHSPGGGRRAGDRHPRRALWRGNRRLDQAASGPPRR

SEQ ID NO: 31094 - protein, 373 aa, Pseudomonas aeruginosa
GGGRRAARREGRVKNDGETQASTKGTISVRLVGEALVEWRRQGGEQGEVLQAAGIDPQLLGKPYARVTSHAYSRLWLDLARRMDDEFFGMDSRRLKSGSFAFMSRCAIHEQTLEPALTGILRFLCLQFDDFQPRLQRRGGLAEIVLDEAPGRYGRALSYFTLWMITHGLACWLVGRRIPILAIDLRCPQPDYIEDYRVMFSDNLRFSRPLSRLLFNADCLALPVRRDKRELRRFLLGAPANILVRYRDPQSLAARIKAYLRSLRPGRWPDADALAGHFFMAPSTLRRKLSLEGQSYQALKDQVRRDLAIARLDAGAANFAELALELGFADGSAFHKAFKKWTGSTPGQYRTQVAAETASAESSGVLSETLGHR

SEQ ID NO: 31095 - protein, 246 aa, Pseudomonas aeruginosa
SLSTLPRVGHGVKIPATPYKNKPRSPAMRDYATTAAGFDLQRTAAATLSGTLQALNACVECCDRHALPGRIALFWEGKDGSRASYTFSELKALSGRFANFLQAQGVRPGDCVAGLLPRTPELLVTILGAWRLGAVYQPLFTAFGPKAIEHRRGDRRQQGAGHRCGQPRQARRTRRSASGRHRRRTEGAGHPSRRFQLLGRAGVLSGRIRTGSAQRRGSVPDDVHLRHHRPGQTGAGAALGDPRLRR

SEQ ID NO: 31096 - protein, 349 aa, Pseudomonas aeruginosa
SASPTRSAPNWSRPSSCSAPATGRRRNWRTHCSDTCASACRRTPTRGRSSSSRNCRRLPAARSSAFSCATRRSPGNARRPHGRPPRTDSAGENDVRIENRVFLVTGGSSGLGAATAKMLVEQGGKVVLADINAEAGAANAAELGAQARFVRADIASEADGRQAVAAALEAFGGLHGLANCAGVAPAEKVLGRNGIHALESFRRVIDINLVGSFNMLRLAAEAMSQGQPDEGGERGVIVNTASVAAFDGQIGQAAYSASKSGVVGMTLPIARELARFGIRVMTIAPGIFETPMMAGMPQEVRDSLGASVPFPPRLGRPDEYAALVRQIIENSMLNGEVIRLDGAIRMAAR

SEQ ID NO: 31097 - protein, 419 aa, Pseudomonas aeruginosa
PCSTPCSSTTWNAAWRRSASAAARRPRSPSSACADAGSEEEEPAMIPCEEEIQIRDMARQFAQERLKPFAADWDREHRFPAEAIREMADLGFLGMLVPEEWGGAQTGHLAYAMALEEIAAGDGACSTIMSVHNSVGCMPIHKFGSAEQKERFLRPLAQGSMLGAFALTEPQAGSDASFLKTRARRDGDHYVLNGAKQFITSGSHAGMVIVFAVTDPDAGKRGISAFIVPTDTPGYEVVRIEDKLGQHASDTCQLAFNDLRIPATLRLGEEGEGYRIALANLEGGRIGIAAQAVGMARAAFEAARDYAHERETFGKPIIEHQAVAFRLADMATRIAVARQMVHHAASLREAGLPCLTEASMAKLFASEMAEEVCSAAIQTLGGYGYLKDFPVERIYRDVRVCQIYEGTSDVQRLVIARSL

SEQ ID NO: 31098 - protein, 143 aa, Pseudomonas aeruginosa
MTMQPFVVERLDHIVLRVRDLERSIAFYRDVLGCVVVKWRDDLELAHLRLGTSMLDLVAVSGALGREGGAAPGGEGRNVDHFCVRIEPFDEAALVAHLEGFGLVPQVPAEIRFGAEGDGWSLYFFDPDGNRVELKGPRVDNPA

SEQ ID NO: 31099 - protein, 66 aa, Pseudomonas aeruginosa
PSRGMPGDPGGAVLVSAGYPMAVWLGALPALWSAADGDGQAIRSTNRRGEACVSPLLRPTRNAFHA

SEQ ID NO: 31100 - protein, 240 aa, Pseudomonas aeruginosa
PRSPLAFLPRLPPRTDLRLPDGCAARRLRPARACLRPGDGRAPSGRRVAGHRPVHRRSAGRGGPDHAAAAAPGYHRELELAPAHAVQRRPGRDPALPGLPPGGAGLPAGRPPPPVADARRASRVPGQADRRAVAGRRAALVRRGLRFAGAGPGYRQCALPGLLPAARLPRDRRGDAGSGARARPPASWRDAGGDLSVPPDAREKPCLSGAWRHKTRMSGGGRRRPRKSGRAPPACVASAP

SEQ ID NO: 31101 - protein, 134 aa, Pseudomonas aeruginosa
TALVAGLPGGAAPVPAAGGRRAGRAGPAAERRQRRQRADQPADAETAAEHRTRRSGGRQLPARRQPAGRRTQAGGPLAGRRPAHRLADGAGLRPGPGAPGALAAERRLALAGRSHARPARSRRQAVEAGRPGRR

SEQ ID NO: 31102 - protein, 298 aa, Pseudomonas aeruginosa
AAAGADPERPQQRLPGRQPGRTVAGAGGKPAGTIADPRRRFQGYGRTTGHLDPECHPARCRRRSQERLPDPRRRQPAGRGRGGGVEPGRAGRRPGRGYPPTAPGRWRRAAPGAGRTPGLARKPGRRRDPGLEGLPLAAPVSAGGAAAGDAEDLQGGSALPGPALPGQFQRGGERSGGRLHAGQPGVRRPRPAQPAVVAAPRRARPGRGPGDVAFRQWRGLGYRPAAQRTEPGVLGRRAAGFTGRSLAQPGKCSRRAAGVGRGSRRQGPPARPAGAIPGARRRRGAALDAGQPRPAPGG

SEQ ID NO: 31103 - protein, 543 aa, Pseudomonas aeruginosa
QGARQRGARPAPARPPGHRPEPSRPALAATLRSPRGTPRPGWQPRGAARQAEPQGTADRLRRAAHRRPRPAGEPRCPAERHSGAGRFRPAQRRNRSRPVQGQCPRRPTPPATGTGPARCLAQARPGLRRATGARQLARSPGARRVEQRRPGLEATAAGAPGAVGRRQGQFRRTLLGIRRRQPLRRRAAPAARAAAALHLARLPAGQPEAMVPRGLRLAGQAERRPATGRSGPRPERRGQPGRRQRYAAPARPGPVGRRRLRQPAPGEPVGAQPRRYLPRLPRTEARRVAGAGADRPAPGEQAAERRVQPGRPRPVGGAPVRADGGETARQAERQRPAVRRPAGAAGRRTGDAERRQHWRRRAADQLREPFPRRSHRWRKPGTRRRLAQRQVRPGQPVRQPELGRRAERRPEHPWQPPAGGGRSLCATGGGTGPEDRHGRAGAGDLRQGPGAAWRHHHPPVAAIHGQGLRRRGDRRLRAARAAAAEDEDGHRCRGRPGQAGVLRLRPQRRTGRPPAHRRQPGYPRRAEPEQGPLSCIRPAPDDP

SEQ ID NO: 31104 - protein, 259 aa, Pseudomonas aeruginosa
NGAGADRQVGARSNSAQGLADMISVYQLKPRFQNLLRPGVQRLYQRGITANQVTLAACLLSLLVGALVAGFASHLWLFALVPLWMFLRMALNAVDGMLAREFGQKSDLGAYLNELTDVIADSGLYLPFALLPGVNPLWVVLVVLLAVISEYAGALGTMVGASPPLRRPDGQKRPGAVFRRDRRRGGQRPVAAGLDRLADVADRGPAVADHRQPRAPGPGRAVRESTGQQRPGLRGNGRTPWRWAPAGSNPAGIPAGATT

SEQ ID NO: 31105 - protein, 589 aa, Pseudomonas aeruginosa
GHHMRDVQELRFTTHDGVELFYRHWPASRPAPDGTRQAVLLFHRGHEHSGRIAHLVDELDLPEHDFFAWDARGHGLSPGARGDSPSFATSVRDVQTFVDHIQAVHGIAEERMAVVAQSVGAVLVSTWAHDYAPKVRALVLASPAFQVKLYVPFARSGLKLMRLWRGNFFVNSYVKARFLSHDPQRIASYDSDPLIAKAISVNVLLGLYEAAERVVADAQAIQIPTQLLISGADFVVHRAPQERFFERLGSLRKEKHILPGFFHDTLGERDRHLAVGRARRFLLEAFATAPERPSLLDADRLGHTCAEAEALAAPLPKNSPRDLYWRATRAGLRLGSLWSDGVKLGFDTGFDSGSTLDYVYRNQPCGSGPLGRLIDRNYLDSIGWRGIRQRKLHAEELLRLAMQRLREEQREVRIVDIAAGHGRYILEALQGVEPLPESILLRDYSEINVRDGSALIESKGLAGIARFVKGDAFDRADLAALQPKPSLGVVSGLYELFADNRMVGDSLAGLGEALEEGGYLVYTGQPWHPQLELIARALTSHRQGQAWVMRRRTQAEMDQLVAAAGFRKITQRVDQWGIFSVSLAQKVAR

SEQ ID NO: 31106 - protein, 165 aa, Pseudomonas aeruginosa
AGACRSHRRNWARCAMPEQTLALVAALLRRGRELDRLSAALTLLAIGLGLYQAVQGIGWRYFAAAMLAIALLGLWQKYWALRVALDAELFERFSHVGDRLEAQTQDLDRALADLGLARPDAAGRTWNQRSHGALRLLRWQALACGAQFLLALSCLLSIPLFNAQT

SEQ ID NO: 31107 - protein, 346 aa, Pseudomonas aeruginosa
ASASRWSPRRKKARRRSSNERAWPCWTWRRKRRPEMNEQTWMLFGGIGALLLLASLVGFVLKWRAGPGPNAVIDNLNARINAWWAMVLVIGFAFWLGQAAVILLFYGVSFYALREFITLTPTRRSDYPALVAAFYFVLPMQYLLIYIDWYSMFSIFIPVYVFLLLPILASLGGDTKHFLERASKVQWGLMLAVFCISFVPALLTLDIPGFEGRNLLLIAYLVIVVQLSDVMQYICGKLFGKRKIAPNLSPSKTVEGFVGGIALATAIGASLWWITPFNLWQAALIALLINLLGFFGGLVMSAIKRDRGVKDWGHMIEGHGGMLDRLDSVCFAAPIFFHVVRYWWTP

SEQ ID NO: 31108 - protein, 318 aa, Pseudomonas aeruginosa
LRFYHSYFPNNRGCPMDRFQAMQAFTRIVELGAFGKAADSLELPRASVTQAIQQLEAHLGVQLLQRTTRQVSLTLDGQAYYERCVRLLADLEEAESCFPRVLNNPRGRLRVDLPGALGRMRVIPFLPEFCERYPELELQLSSNDRLVDLLREGADCVLRVGELHDSSLVGRHLADLPQVTCASAAYLERHGHPRQLAELGGHLAVNYQSPSSGRTFDFEFSVDGRLRTLPMRSRVSVNNADAYVAACRAGLGLIQAPHYHVAAGLADGSLRQVLGEWLPPSLPLHAVYPSQRQLSPRVRVFVDWLVELFGRQAAGETQ

SEQ ID NO: 31109 - protein, 531 aa, Pseudomonas aeruginosa
SPRPRPGVGAGPRRGLRNAVSGASGVSPEYVHIAEYAGRRGVADTDHLVRLALAAVGGAEHLEGAGVAHRAEVAPELRGDAPVVGVFHHALEFAVLDQLAPFAAELELVACVVDRPGAVVGHQHPALDTGHQLREALVTGLQVEIGHAVDGRAVPTAGAAVGDALQAAAVLRQGAAERAQQAAFADQVFLARGAAVVVLAVAGQLLGDFRVEADVEQAGAVLVATEVLGLDEAGPGVVALVAEDAIQLQRVADRLVDLQDHLVRHQQQVAAAARGVRRRQQLQGLVGDARRGADQAEALDHFGAALLAGMVAAETAGLAVMAVVGGDAGARIDEALLVVLLGAGAVQVELFLAADFEEYAPVHQALVARHLGGLLGEQFVALGEGGERGVLVRRAILRAAACRRQSADVEQGVPGDPLGLPFGLLQGGLQAGRGEIVGGGVGFHAVQPYAEHGAAVLAEVRRFVDVAAHREVLAATLDVAQGVEFGATAERREAVFQRVDHLCVPGRLRSGRMQNAIFQAFVRNGASRLLS

SEQ ID NO: 31110 - protein, 414 aa, Pseudomonas aeruginosa
IQVPYPAPVADHRPGLRRRDRPGDVAGGARLGTVLRRATRSRRQAGRRAAQGQRAHRRRGQGGAGRPGAAFQRAWHRHRLQHGERQAAGQRRAGQGAVPGGAGGQGRRPAGGGRPAHLQGGAGPGRGHADAEPGATEERRDRPAALQGAVRRGLDRQADPGYPGSPGPPVAGHHPYQPGPGRRRPPQSDLHRGPRTDFRAPRPAPGGHRQPGHQRRYHAAGGDHPGQADLGGVQPAAAADRHRRRADERPRQAGGHRAGPQPGQGSRRRHPDHPGQPDRHHHRHGQAQGALRERRRQAVPQPVRQRAPAGAYPQGRADHSSQRRAARHQRYLCVRGRRRQQGQPAQRRHRHQRERAGGGGKRPEGRRAGGGGRHRPPARRYGSACRRGLPAGPRGRAAETADWPPQRPPGRLGG

SEQ ID NO: 31111 - protein, 1043 aa, Pseudomonas aeruginosa
MNPSRPFILRPVATTLLMVAILLSGLIAYRFLPISALPEVDYPTIQVVTLYPGASPEIMTSSITAPLENQLGQIPGLNEMSSSSSGGASVITLQFSLQSNLDVAEQEVQAAINAAQSLLPNDLPNQPVFSKVNPADAPILTLAVMSDGMPLPQIQDLVDTRLAQKISQISGVGLVSISGGQRPAVRVRANPTALAAAGLSLEDLRSTVTSNNLNGPKGSFDGPTRASTLDANDQLRSADAYRDLIIAYKNGSPLRIRDVASVEDDAENVRLAAWANNLPAVVLNIQRQPGANVIEVVDRIKALLPQLQSTLPGNLDVQVLTDRTTTIRASVKDVQFELALAVALVVMVTFLFLRNVYATLIPSFAVPLSLIGTFGVMYLSGFSINNLTLMALTIATGFVVDDAIVMVENIARYLEQGDSPLEAALKGSKQIGFTIISLTFSLIAVLIPLLFMGDVAGRLFREFAITLAVAILISGFVSLTLTPMLSAKLLRHIDEDQQGRFARAAGRVIDGLIAQYAKALRVVLRHQPLTLLVAIATLALTALLYLAMPKGFFPVQDTGVIQGVAEAPQSISFQAMSERQRALAEVVLKDPAVASLSSYIGVDGSNPTLNTGRLLINLKPHSERDVTASEVIQRLQPELDHLPGIKLYMQPVQDLTIEDRVARTQYQFTLQDADPDVLAEWVPKLVARLQELPQLADVASDWQDKGLQAYLNIDRDTASRLGVKLSDIDSVLYNAFGQRLISTIFTQATQYRVVLEVAPQFQLGPQALEQLYVPSSDGTQVRLSSLAKVEERHTLLAINHIAQFPSATLSFNLAKGYSLGEAVEAIRGVEASLELPLSMQGSFRGAALAFEASLSNTLLLILASVVTMYIVLGILYESFIHPVTILSTLPSAGVGALLALMLAGQEIGIVAIIGIILLIGIVKKNAIMMIDFALDAERNEGKPPHEAIYQACLLRFRPILMTTMAALLGALPLMLAGGAGAELRQPLGITMVGGLLLSQVLTLFTTPVIYLYFDRLARRWAAWRKQRGLDLNTEAGFDGDAGR

SEQ ID NO: 31112 - protein, 96 aa, Pseudomonas aeruginosa
ARRWASTARSSLPIRRWKTWSASSAAAAGSRATPVRSSSPSSRSANATRWRRSSPGCASGSPRCPARRSISTPARTCAWAAATATRSTNSPCAATT

SEQ ID NO: 31113 - protein, 561 aa, Pseudomonas aeruginosa
PCTPPRWSTSISTACATGSTRNAAYARTVRWRHPYETHPLVARPGPGRRPRRLRHRPRLPATGPGGARRIQGSRRLAPRRAARRVPARRLVGAVRRPDPERPADAPGTFQPDPGPVGGAVPPGRGAGARRAGGVLPVDHRQRGQDPQRPGRRRQHRAPARRLHCEQRRWFRCDQQQLLDQPRCQLGGRPLGQAAPATGGQPGEPACQRRRPRRGAPQPAVATGAELPATAGDGRTDPPAQRHGDGLRAFAEGGREQIPRRHRHQGRRGPGPHPVEKHPGPGHRPEVPACPAGARHRRAGRPAAGAIQPAAGGERAEAAGPAGSGAVAIARAAAGHRLGGTQGDFRQRPDRRGQGRLFPRPHPERRRRLPQRQPEQLDQHAEPLLVDRPAVRHDPVRRRPDRLPGGPGRGDLRPDRGDLPADRARRFPRGGGLPGAIERPRRGERGAARSPGVGPRGTAPGREPVQGRHRRLHRRGHQPGHRAEQRTHRADPARQPPDRQRPVDRGNGRRLGQRRYRADRRAARPGRGGPAAFALSSSRCLFLTNAFPRYCACMTHRRPRLG

SEQ ID NO: 31114 - protein, 446 aa, Pseudomonas aeruginosa
PGRPPGGSGSTVRGRHAPPTRRSGRSMAGGRAGPAGWRGGNRRAGARRRCARCSATPVPGCRSSCAWKRRCSAGAGRCRCSSSGTPAGGHPPASGREARGWPRRWPRPGRRSSSAAGRCGCRECSGAGRCEPPVGPAGHAPVRPGRCAGRDRLPGCGGSAPASIAGFPARGLPARGRGSSAPLRRAPGPAARRGRRPAGPGAATVGLVASSARFQDVADAANGMDQLEVEAVVDLRPQAADGDFHHVGVVVEVHVPDQRDDLRPGDDVAVAPHQQVQQGELLGRQVDPHPAAEGPVAAGVQLQVGDPQDVLHRCLVVAAQQRADPRQQFGELERLDHEVVGAEIEAAHLVGQPAMPGEHHHPRAAAFAQAAEQVPAVDAGQVDVEDHQFVRVLQGHVQAVDAIVGAVDDVAAFGQALVQVVGSLDFIFDNKDAHVRPYIKYGFICK

SEQ ID NO: 31115 - protein, 517 aa, Pseudomonas aeruginosa
AWSACSAKTSATSASEISGAGRRRAPRTVRENRMGKKTIIAVTALALLGLGGGAYLELGGKAPAGAGEAAAEGEGSGPRGGMLLRQGDLTLELLVPEDGSPLKAWVERGGKALAPQEVVLGADVERATGEVEDLLFKASGDGLVANAGIAEPHAFTARLKLMAGKQGYDFAFTREEGKLELDAEQIEAAGITLDTARTISLAQVVSLPGEIRFNEDRTAHIVPRLPGIVDSVPANLGQAVKQGELLAVISSPQLSDQRSEFAAAQRRLSLAQSTYKREQQLWKEGISAEQEFLLARQGLQEAEIALNNARAKIAALGGNPSLQGGNRYELRAPFAGVLVEKHLTQGEPVDGTANVFTLSDLSSVWATFNVPAQLLGQVRVGSKVKVLAQALDSEVEGTVSYIGDLLGEQTRAATARVTLSNPESTWRPGLFVSVQVAEATRKEVLTVADGAVQDVDGEDVVFVRVADGFVVQPVKLGISDGQRVEVLEGLRAGSQVAASGSFILKSELGKGSAEHGH

SEQ ID NO: 31116 - protein, 664 aa, Pseudomonas aeruginosa
VPLQESSHVRTHHPIRHRATLAGPAGGAGDGRGRHRQLPEAVHRRGPGHHQRPGADQYRRPRLLAAGSGAADHLPGGDRHGRPAGFAGNPFAVAAGDFPGDGDLRGGHRYLLRPPAGQRTPEHGARATAGRHLADPRADLHRSRRDLPVDGGGRGGRDQGGRQRLHAHRPAHHPGLDHPSAVAQREGRGRDQHHRRLRQAIPHRPGSEEARGLQADPRRPAERCAAQQRERRRRLHRAARRAVADPRAGPGQGHGRYPRDHRFQRRRRADPYPRRRRGRPGQGAAHRRGHRERPRSGARHGVHADRREQPGSGPGGRPAPGGDQPDPAQGGQGDHRLRPHHPGGQGRGHGEEEPGGRRGAGDRGALPVPRQHPRGVDHRHHHPAVDAVHLHRDGRQQGQRQPDEPRRAGLRHHRRRRRGDRRERHPPPGPRPGPPRPPADPRGTFPRGLRRVQGGAPGAGLRPDHHHGGVPADLRPHRGRGEDVPPDGVHRGHRAARRDDPLGDLRPGGDRAVHHRQGQGGGELRHAPRASGLRTGAALGARAPRAGGRRRPRRDPAHRAGGLADGQRVHSQPQRGRLRHAGPAGAGHQPDPVGRDAADPGEEADGQVPGDRAGLRPHRDRRDRLRPDAAERLRQLRDAQAAEPVAGPEEVAGGAAGRIAGRGP

SEQ ID NO: 31117 - protein, 436 aa, Pseudomonas aeruginosa
GAGQRLRVLPADPVALQRTDLRGAQRRRGEGLRRRHAGAQRHRGEDLQGAARHRRRLRGEGRADHRPAGADGGHRPRQGGTLRPQCRRHPGHRGHRPRRTQRRYPVRGRPPLRHRHPPAGNPARRPAGTVQPADPAAAEQPGADRLHPAVGRGAPRPLAGTEPDQPGERQAAHRGQRQRARPRHRLVRAGSATEAAGRGEDPGRLLDHLGRPVRTVAVRRQALAGSGAGGAAAGVHLALRHVQQRQGRPAGVHRHPLRPHRRGAGPVAARDTAVDLGGGGFHRPVRGGGAQRPGDDLLHPQPVAGRTQPRPGGVGGRHHPPASGADDRPGGVPRFRADGPGHRHRRRGAAAAGDGGDRRHPVLDHADPAGAAGALSLDPRARRRTARGDAGGRLKRARKRAGRGNPGGPFSLAVGRIPFDYRTRLPARIVAGGGLA

SEQ ID NO: 31118 - protein, 344 aa, Pseudomonas aeruginosa
CGWTFRARRLAPRGDNNNDSSLSVLPMNASLLSERSRVFERADPYAVSGYVNRHVGTHCIRLPASGRPQASLDHRTFASLDLCRISYGAAVRVTSPALESIFHLQILLRGHCLWRGGGQEHALAPGELLLINPDDPVDLTYSADCEKFIVKLPCALLEAICAEQRWSHPARGVRFLEHRYRLDQLEGFVGLLALVCREAESGERLARVDSHFEQILGSKLLTLLKTNVSREDPGDAQVVFARLDAYIRRHLQSEIEVAALAEQAHMSTRSLYALFERQLGESPRQYIRRLRLERIRACLEDPGCRVRNLTELALDFGFAHLGRFAEQYRRQFGELPSETLRRRA

SEQ ID NO: 31119 - protein, 561 aa, Pseudomonas aeruginosa
AACAPRTKGCSYCSIATGRRRCSPPWSANGRSAWRCGRWRHEPGLRRPARFPLPRGALSRRQGLGRLAGVVRRGRQFLDAVLGRPRPAHRGPAAGNLADLVRQPRRPGGPGIPHPHRALQRDPAGHPHLAQPEQHRTARRGRRHLPRALQLAHPELSLQDRGQLLRHHLLRPRRTRRESADQGQESDPEERLRSPADRRLPRLTPAPAGCRGTCHEPSDRTQLRRRGDPLHPCRARRDRGRRGLPPGHQHPPGLPRRRLRHLQVPGRGRALCAGPGLHRRCPQRRGSRPRLRADLPDARRKRLRAARAGVLDPVQDRPGALRGAHQRSPATLAEHHRPVAARRGAGQPGVPARAVRQPPGTRQRAAPRLLLQLAGEGRRGQLPDPQRPRRADERLPQWHGQGRRQPGDGRPAGQFLPARDSPATADAGRRHRPGAVHRDARTDRRTGQRAPAAPGLRGDPRRRPGRSRAPGGVRRTDSRLHLERVRGQRRQRLSAQGLRDRAHRRAAPARGRRRHLPVRAAADGRGGRALPARAGRAPGEFLLRKVRRQRGLNPSEPRRFP

SEQ ID NO: 31120 - protein, 136 aa, Pseudomonas aeruginosa
GTAGGSADSAGWRRSRRAGSRCRVLAGARTGRAGSPTGGPRRRRRGGAARCPRRAGAVRAPRRCAPGPRRRGRGSRRSRSRRPRRSAPGSGRRAPCAAPGRRRRGCPRRRSPGCSCPPRSGPCRCRRPLRGSPAAG

SEQ ID NO: 31121 - protein, 1299 aa, Pseudomonas aeruginosa
PALAAGLRLPRRCARCRSGAGCAASARWTRPCRCGYGTPGLPGRHGWGSRSATSRASDRGCSAARTPTAAGGTRTVRRTARGSRPSPGHRRVRRGGRGTVRRGTAVRRSWGHLLRAQGQALQAVEEEAPPMRVLVDVEAFVGDLGAGQQRRDTQRLAVRRRAFEPLAVAAGDVAPALQAGLEATLGFAELHQVVGRAHPGDVEEVLELADPVLPVGVRLALYADALADDLGTVPGQRADDAQLRADLVDDEQAGVEIEVAQAMHHPLGAGLAVFRHQPRHHAGVAGAYGGVGHLAEEHAVAVGEGEPAVVGGRVAGAELAVVEGGGHAAALGLDLLAVLHGGYVVVVHCADVIAVQAILVLQLPVAFVGVGGGAGQHFQLAAGRLRHQHVEEHPGVAEEVHQVVLAGDVQADEDEAPVALDARFLQATGGLVEAFRVFARRLDLHQPAVVLVAPGMERTGEGRLVALADPHQGRAAMLAGVDQRVQLAVAVAGDDQRLASGAQGDEVVGPGQFAFVAGVDPVLFEDQLHLQVEQLRFGEHVPGDAEDAFLGTEVEAAADIVAPLFEASAGSVHAFSPLCVVVMGDPFNGRERGRAIRLVDDAHPENPQPPRSGRGARGGLGRGSSGACGGRFVRKVGERYPDSGGCGEPALRRHMPCILLKTERQQSAPPALPCRVPNHDEDPSRRRSWRSPCRPPGPGRRPFLDVEGLRAAPARSGEPGTGAVRAPRQRAEVDVHHPWLHRLRYRRHHHRRGCRGVQRLQPEPAAQRRAGAVPGRAAPALRRPPRGDHRAQRAPGAEHRRGLPQAAGGDRPHGDAQGPGGDVAAADRYALALRSGDGCPGWRLRVLVAHRAAHQRGDGAQRTLRPGVFQQRPGTRADQGTDPGPAEQLQRGPAAGPWRAPAALPAARPRVSPGQRPRDPEPGGRGTRRRGLAVQAVRGLPSLLRGVADELPEALPARRGARGNPRQRRRPQHLDDRPGLGLQPPRTLLRGLPQALRGNPEHDPAPRCAALLRGRSGVLAADQRQAAPQVRGAVALAPADDDRRGQGGVGQGLVGDVVAVLQLHRGRHQGRAESGGDQADGGLHLVGPLRHAQAQAVGGEQRQHVVGVSRPRLAGVEHERLARQALQAQRLAEQRVPGGQGGDQRLFAEHALADRRVVDAGCVRNRCRYARSSAPRPVAGWSSPAGPAPAPGRRAGGGSAPAARHTAPRARSRCRTTGAGPGPIRRVLSQMLSSWSRSVALCSWKKRPASVRRSGRPRSSRATPSISSSCWICRLSGGWAMCNCSAARVKLRVRASAWK

SEQ ID NO: 31122 - protein, 403 aa, Pseudomonas aeruginosa
PGCRCFPTWTSRSTGFAGIPRRSMPTTAEIPFPRPTTTSRGKRHDREDFPDCRRPALLRRGQRPAQRTRRSAHQGPGAARPRRHGEADRRDAGHARRILESGGLPEPPGQPPGGRPAGRRAGPGALPGPAARRPGRRGRPHRRHAAHHRRAAVRRRRAAERWRGTDGRRPRRRHRDVPPGPRQRSRRPAAGRGHRRCLARQYPRHLFLLRQQPVRIQPAPAHPHRRRRPLPCAQHRAVRLRLPKRRPDPGTARPPRPPRPAAGAHSLLRLGARPSPPDHPDQPGGRPLPVGRLRLCHPRWADRRPALQRRPRRGPRPRRGGRTLRRTGFRLPAPVQPGARRRAPQPAAAGIAGVRRETGRAAGRWRPCRLLPPGATADKKRRHDWRLRTCPKEQPKKDKCIAR

SEQ ID NO: 31123 - protein, 259 aa, Pseudomonas aeruginosa
AGRRAVPGRAWLRPAGGRRDPNLGHAIPPMPPGHRRARGSPGYGRRVASQAGVDMASWTLVDASAIAVRHPYTFYKPDAETIDRVAAGESVKLIFAFDTDNPDAPRAERLWVTVEGIEADGAFSGRLDNYPQYIRDLSLGERIVFEARHIINTEHDPRETPISRYARRCFVTRRVIDEGKAVGYLYREAPEEENDSGWRLMAGDESDDYMNTAGTTAYVSLGSVLNADDSILPLLDAPPGRAFERLADGSFIEVQGPEG

SEQ ID NO: 31124 - protein, 536 aa, Pseudomonas aeruginosa
QVFWNRSGQAFGKTLDVFGGHRRLGVVHHAAVEHGQAMGQQELAFGGGEFHSLWSCRFGAATLARRGCAFRNALAIMRGFPSALAGVRRTMHTLQQLRSGELAGATRLDLSCGLREFPREIFELADSLEVLNLSGNALDSLPDDLGRLHRLKVLFCSANDFDELPAAVGDCPALSMVGFKSNRIERVPAAALPPALRWLILTDNRIATLPEELGRRPLQKLMLAGNRLEALPESMAACEGLELLRIAANRFQRLPAWLATLPRLAWLAYAGNPLCRLPALADSGIAALDWSELSLDGLIGEGASGVIHRAGWHQPDGSTRTVALKLFKGEVTSDGTPASEMAACLAAGRHAQLIEVLGQLAGHPQGRDGLVLELLDDAYRNLAGPPSLESCTRDVYPPGLRFELATALRLAASLAALMAHLHGRGISHGDFYAHNILWREDGACLLGDFGAASFLPDDAVLAGALRRLEVRAFACLLEELLERSEAPPGQASLRAALVELQRRCALPRVSERPDFGEIQAILRDLAARSQAFPQVR

SEQ ID NO: 31125 - protein, 260 aa, Pseudomonas aeruginosa
RPIAAGTRLGNQRLTTPGTSAWMIATPLPASAALAISASPLSSSRRQRQAAAMASSPQTMPRCSASQRPSQGSNSATRPMQSTGNTVSSDAPWKPRPVPAVISSSSGPMPVRIGRRLMPRQKITSRPTQLTSAAPTPLAAWPPEGIRALMPGVAAIAGTDPLRRQDAGRVAAGSAAVAGAPSRRRAWQWTGRTLRRPRWNRRTRPPGCRRDAWRPDTSGRDGRWRRSHNRPDAGCRAPDWPGGSPAVRRGHWDRGSRGSG

SEQ ID NO: 31126 - protein, 317 aa, Pseudomonas aeruginosa
ALAKSMASMSCMLKLNDVMPFSGSVHARSGPAPYLRQRCRHRQLHPRRRTPAPDPVHRQPAGHPPRTEPRLPPARPQPAAGFADRGRRASAWIRAAPAAALGRGQRGPQPGPWRRRAAPRRAGRPRRRSADAGADALHRRASATAPGGRERSQPSPAAPLSQRRAGPAAGQAVGGRQRLPCTLGRAAGLVRQRRAAVRRGFAGGAGAAGGVPGRRAVSPGDDPCPGEHRASLAHRLFQRQPGQPGGRGRRRTGGQPAAAGLRRARASPAWRAGRLPAHRWPGAGALRAARAGQRRAHLRDRLRDLCDARLEGLQGER

SEQ ID NO: 31127 - protein, 172 aa, Pseudomonas aeruginosa
IVGAAHDEDDPRRLRAQAAEQGRQQAELDVVGKADAEHRGAGRRIELAGAAHGGGDGVQRRRQVGEDFLGSRGGLHAASGTDEQRVVEQRAQARQRGADGRLAEEQFLCGAGHAAFVHQSLEHDQQVQIDAAQVVSVHGVPRFQGLEAATAGARRQALRARRGGAWRGAGGA

SEQ ID NO: 31128 - protein, 375 aa, Pseudomonas aeruginosa
CTAEVCDVPSDPFSSVWPARGPQMRRAADPGAGRRGSPGACPGDRRELEGCALASEPGPGAGCAAVRSRLRTGRRGAGGRRRRQRPAAGFPRGQFPRPYPRSLSGLWRRGADATRGPGGLPRGTHPGGGQRLLHRPAGGLFRPGRPGRVEGRADRADHRGGAHVRAGLDPVGQGSRRAGDRFHQVRRGARVPPRAGRRQGGGDRRAGPGPGSRALHRGQGRQCHPRRIGRPADDPARRCLRHPRQAGAVWLQRRQRVGVPGLRRVQEAPAVLPPLPDGFHRSSRDGPGTQRRVGEQGPRAHRATDPRSPAQAGGRPGIRVRPGGRGAPLHGNLSEARPGGDPRRRLRTIRSERARPSSRAFSWGTEVSGFWSPAR

SEQ ID NO: 31129 - protein, 156 aa, Pseudomonas aeruginosa
VRSKPSNNGMFSCRPMLRSRSRVSPLNAIAWSLWLRARLALSARLGRPAARLSSTEAAAAFSRAWAASSAGCSRRASASISSMALTKPVSGCASSSPERRSGVSGARPMRRAMTPKALLRAPSSRTWAKLAWDSAVCACRRSERAAAPARYLASAA

SEQ ID NO: 31130 - protein, 98 aa, Pseudomonas aeruginosa
PDCACPPRGGPPSNFSEMERTMSVDLKKIAAAFPEFQLSSKSRHDGALLLQLQAADGRYVARTIPSPQLSAPPETEWLIRSIRRELAVPGMEMAMAAR

SEQ ID NO: 31131 - protein, 158 aa, Pseudomonas aeruginosa
VAAGRQVHRADIGIAPAHHAADHVVALALPGLWRVLLVPGVVELAILLRQAQAVAVAHVEVGAGDHPADLRAWHRLARLEVHHHRAGAILLGFLRQPAEAEVAAVAVDLADARHQVVQVGFGALVGAVVPRAVAPPAVLPAAPLVTDHPGRDDVKCAR

SEQ ID NO: 31132 - protein, 405 aa, Pseudomonas aeruginosa
IVTHFLVVGVWGVYRDSYCKLYGAGEMELVFADEGFQINGVSYPGFPIILTAELRSIPEVSAFLIYRCLHRGRVESKHTWASYGQALYDYLGFLNAANRDWRDVGFFELGSSPLAAYRDWSMRSCGLSENTINLRLRVVCSFYNYARRQGWIERVPYDVETVRVAVHSVFLAHVDVTGGYVASPDILMKGKRTAIKILTKEQVRIFLNAVSCSTQKLIARLALSSGLRKEELLTFPSSYIFDPAQISKGSSHFRVFCSPKDMELKGNKAREIDIPRSLMAALWQYKIHERNRSMQTSCVESIPLFLSRYGVPYSPKGQSLNHMWKDLGLPFTVTPHMLRHTYATHTLHDMRRRKSVIDPLLYVRDRLGHSSVATTQRYLHLISMIEDDVMGEYQEFIDSVCVGRI

SEQ ID NO: 31133 - protein, 365 aa, Pseudomonas aeruginosa
SLSNLLATLNTVGSGSYAPEDVHFLLRSVQMNVTDVEEKERLIQTNQKHYSEMISQEHAPTDVHKSLYARALVLNGARMAEDVQSLALALSAVCTGSSIALVSFVRAGLPLGVLLRRALVEMGRDAHHYGVSIIRDRGIDTVALEAIIQLHGAENIVFVDGWTGKGAISGELKRTLGADKRFPEEPRLVVLADPCGRAWLAASAEDWVIPSGILGATVSGLVSRSIWPTQGGLHGCVVYDHLSEHDVTREFIDKIEAERQALSSVQTASPWTHEQSLKLQAAAENVVTSLATRFGISNLNRVKPGIAEATRAVLRRVPDHVLVRDRNDGDVQLLLHLTERAGVTVEEAGEALGPYRAVTIIRSTN

SEQ ID NO: 31134 - protein, 410 aa, Pseudomonas aeruginosa
RPHCGRPRQLGYSGGTRMTTLVPGGNAPVATGQLRVDISYTPAPGADIDISAFALTTSGKVRGDGDMCFYGQTSILGGAVQLTANSAGRAEFTVDLSRVDPAVEKVALTATIYENKATFDRVSTLSLALTGGIEAQIPTHGMNETALILGEFYLRQGAWKFRCVAQGFAGGLGPLAKHFGVEIAAPPSAPAPTPAAPPQVPPAPPKPTISLSKVTLDKSRSSISLDKPAAGFGEIKVNLNWNQGGSGGVLGGIFGKSKSVDLDVGCLFELQDGYKGVVQALGEAFGDLNDEPYIQLMGDDRTGSVAGGEWMHINGRQWSEIKRILVFAFIYEGAPNWKATDGVVTIFIPGQPEIEVRLNEEGGRYGMCAIALLENVNGAVKVSRRVDFHRGHQDMDKAYGWGMRWTAGSK

SEQ ID NO: 31135 - protein, 199 aa, Pseudomonas aeruginosa
QPQGAVYMALSLQKGGNLSLSKEAPGLTKILVGLGWDPRSTDGTQFDLDASAFLLNASGKVRGDADFIFYNQLKSPDGSVEHTGDNRDGAGDGDDEAIKVDLSRVPVDVDKIAFTVTIHDAENRRQNFGQVGNSFIRIVNETNGSEIVRYDLAEDASTETAMIFAELYRHNSEWKFRAVGQGYAGGLKALANGYGLTVN

SEQ ID NO: 31136 - protein, 368 aa, Pseudomonas aeruginosa
NKMKAADMFDLDHSLAQEIVDRAMAILPRNVNVMDSQGLIIGTGEAERLYTRHEGAQLVLTNSRAVEIDNAAAGALRGVQEGVNFPLCLDGQVIGVIGVSGAPDEVRTFAEMVRMTAEMLVAQRNDQQHRIWLQKRIEDVLTAILLSGQSAQRAIVEAQRLGLRPDLRRTAVLLEMATPEDLDLAAEWIRHQAADAWCVPLHALGLVWCPPRSAPPDFRERIARAGIPFTRVAIGTPNTETKALHSEVEQLSDLMAYAQAKMPDAQWLDLADHRIPVAVWRFRSENGFLQLALPYVALQQEDSNGQLRRTLKCWFEHGSDGQSCAEALNIHRNSLRYRLERIADISGVDLASPKGTTELYLAMILAAE

SEQ ID NO: 31137 - protein, 405 aa, Pseudomonas aeruginosa
RMISMQLRAAVSGLLLALLAGQTVAASFDCSKASSFPETEICRDGYLSGLDEWLARSYKTALEVNPGQSDAVRQSQREWLATRNACTDQQCLDSTIGARIQALDQYVTAEKGKAASALAHAQLNKHQEAEAIRQRQTAERLGTEEAARQAQIENQRQLAIIELQQRGQAAQALETQRAGEHQQVPAQIPQYQPPQKVAPASSATSSSPSYRSPEKTLWQQFKSSPAWKYLLLAGALLTAWAMWRHHQGQTTIYNDYTDAAITNLLPAAGVVLAFLMNWLELPRQLAMVAGVTGFMLALMFAVYASVRTNQGWMSISLSLIAKMTLVSVFYAVIGALVASLFLSTKYKGESQARANARNRREKKETMAMISVLTTAYTFLSAWLCRRQEFISVSECLAFDSTASVA

SEQ ID NO: 31138 - protein, 437 aa, Pseudomonas aeruginosa
PRFMQSRLTLPAHKPRNRRPELNQSLKPGENTTINQSKGQVLVTHSAGANLDVNLTAFLITDSGKVVDDSGMVFFNAPEHASGAAAFSPPIIQAGSISHSISFDLSRLPASISKIAITLTQDGTGGGFAGVPNLSARVLAGDQVLDLAPGAFERETGIIVLELYVRNGQAKARSVWQGFASGLVGLCGMYGVEVDDEPATAPIPAAPPAKPVSITKTVITLDKPGNTHKVSLEKGAAAPKVIKVSARWVDNGDGRDNDDLDLRIGILRPDGRMSIIQAPDKRGSFEADPFVFHTGDVVSASTSAPGIETVEINAAISHLMGGKVALVCSVYSAVDNGAVSVASLKPKMRMEYGDEVVECAFEFKGGFFSSLVYTYVLGMIEIDGDEIRISPSGVTSKTGSEATPWLTRKGDRVELTMDGPHVFKGRPLERKGNKHYV

SEQ ID NO: 31139 - protein, 374 aa, Pseudomonas aeruginosa
WTKRAKATAASRTRRGSRDDQERGGNPAHERGRRAHRESPRSPRRGGAARHQHGRDRPLLRALHRRHPRGDSRQQGAVRLSVHGEHLGQRGGLSWLAVGAADPPRRRYRQRRRHGDQGRLFRRQQQDVPGRRHRPPGAEAARRHPRMPVPGDPRGAPGRHPRRYRACHPESRRSQRLFGGPRILRAWHRPQDARGAAGPALRSRWRGCAAEGRDDLHHRTDDQPGRPRGEAAQGRLDRDHPRPPPVGPVRAHRAGHRAGLPGPDPARRGARGAGRPGWLIDARPGYTATTFPKGGWRVSGRRFGEFELRATWLREDSGYLAEIEITSIDDGRTEWLVLPGQPPCESPAAALSLAEAALYRVRGFDARGRPLFSD

SEQ ID NO: 31140 - protein, 97 aa, Pseudomonas aeruginosa
TIMEKSIKMLFDAFQATFAVSTQMRPDGGALLTLRNGEEIVTRRVVSAAQLADEKRMYWFINAVRRDLALEAGSLPVDVVGTLRRLQERGLPSYMAG

SEQ ID NO: 31141 - protein, 114 aa, Pseudomonas aeruginosa
AGPGVWKRSSATFRRMTLDNAMTLVGQVADQPPALALSELRSIDLPSLILNGERSPLPFPATAEALAAALPRAELQRIQGASHGLNATRPAAFNRSVLEFLARVDGVAPDVETS

SEQ ID NO: 31142 - protein, 669 aa, Pseudomonas aeruginosa
GRPARRATLTGTSQPTWPLVGVTTRRGGAMPIITLPDGSQRSFDHPVSVAEVAQSIGAGLAKATLAGKVDGRLVDACDTIDRDATLQIITPKDEEGLEIIRHSCAHLVGHAVQQLYPTAKMVIGPVIEEGFYYDIFFERPFTPEDMAAIQQRMRELIDKDYDVIKKMTPRAEVIELFKSRGEDYKLRLIDDMPDEKAMGLYFHEEYVDMCRGPHVPNTRFLKAFQLTKISGAYWRGDSKNEQLQRIYGTAWADKKQLAAYIQRIEEAEKRDHRRIGKQLDLFHLQEEAPGMVFWHPNGWSVYQVLEQYMRKVQRDHGYVEVRTPQVVDRILWERSGHWSNYAENMFTTSSESRDYAVKPMNCPCHVQIFNQGLKSYRDLPLRLAEFGACHRNEPSGALHGIMRVRGFTQDDAHIFCTEEQVKKEAADFIKLTLQVYRDFGFTDIAMKLSTRPAKRVGSDELWDRAEGALADALNESGLAWEYQPGEGAFYGPKIEFTLKDCLGRNWQCGTLQYDPNLPERLDASYIAEDNNRKRPVMLHRAILGSFERFIGMLIEHYAGAFPAWLAPTQAVVMNITDKQADFAAEVVRILGESGFRAKSDLRNEKIGFKIREHTLLKVPYLLVIGDREVESKAVAVRTREGEDLGSMPVTQFAELLAQAVSRRGRQDSE

SEQ ID NO: 31143 - protein, 72 aa, Pseudomonas aeruginosa
SLNAEYPNMPKMKTKSGAAKRFKKTAGGLKHKHAFKSHILTKMTTKRKRQLRGTSMLNKSDVARVERSLRLR

SEQ ID NO: 31144 - protein, 354 aa, Pseudomonas aeruginosa
GKSLTALPLFCIWSPYMENLDALVSQALEAVRHTEDVNALEQIRVHYLGKKGELTQVMKTLGDLPAEERPKVGALINVAKEKVQDALNARKTELEGAALAARLAAERIDVTLPGRGQLSGGLHPVTRTLERIEQCFSRIGYEVAEGPEVEDDYHNFEALNIPGHHPARAMHDTFYFNANMLLRTHTSPVQVRTMESQQPPIRIVCPGRVYRCDSDLTHSPMFHQVEGLLVDEGVSFADLKGTIEEFLRAFFEKQLEVRFRPSFFPFTEPSAEVDIQCVICSGNGCRVCKQTGWLEVMGCGMVHPNVLRMSNIDPEKFQGFAFGMGAERLAMLRYGVNDLRLFFDNDLRFLGQFR

SEQ ID NO: 31145 - protein, 218 aa, Pseudomonas aeruginosa
LPVARRPGPRSQRHLRRTAGAGGGGRGRRAARRDPSGRARRAGCLPALPRPGDPQRRPEPADPVVDGRAPAPFRHSQYRSGGRRHQLRDDRTGPADACLRPCRDQRRRARAHGRGRREAGPARRPGNHPARRHPGDRRPPARPGHRRGDGRRAQRRQRQHSRPVPRSRVLRHHRPGRQGPLLWPAHRLLASLRARRRQPVGAQGHGARDAPDPRHRRR

SEQ ID NO: 31146 - protein, 220 aa, Pseudomonas aeruginosa
TGADRRAGQRSAPAEGRADHPARRARDPDARHAAGRRRDRAPAASPGTNGGSRRGRAVVGRRTEPSLRHFPGSRPDRGTGPSLRLQPPAGALPAGAPGAEQQAGSARRAAAAAAPAGRPRLSGSDHLQLHRSGPVRTVRSGHPAADPGQPDLRRHGGDAFQPLAGPGQGAAAQPQPPAVAGPPVRKRPALRRSTGRPEAGSHARRRHLRQAPAGRLGQRP

SEQ ID NO: 31147 - protein, 817 aa, Pseudomonas aeruginosa
SSLGVVMDGAQYSERDICTKLITPAIQKAGWLQHQFREEVSLTDGRVIVRGKLATRVKNPDAKGGPKRADFVLYARPNLPIAVIEAKQARFSVGHGMQQALAYAEMLDAPFAISSNGEGFLFHDRTGLTQPIERELSLTEFPSLDDLWPLYQQWKGLVTDTVVKLVEQPFYSDGSGKEPRYYQRVAINRSIEAIAKGQQRVLLVMATGTGKTYTAFQIIWRLWKAKAKKRILFLADRNILVDQTMQQDFAPFGEVMHKVTNREVKKNYEIYLALYQAVTGREEWKQIYRQFPADFFDLVVIDECHRGSAADDSAWRDVLDYFSSATHLGLTATPKETKEVSNITYFGDPVYTYSLKQGIEDGFLAPYKVIRIATDADAVGYTPEKGKVDKLGQTVEQRQYNTKDFDRNLVLEKRTRLVASKVWEYLKATDPMAKTIVFCDDQDHAERMRQELVKLIPAAASNRRYVMRITGDDNEGKAQLSYFIDNDELYPVIATTSKLLTTGVDAKTCKLIVLDQNINSMTEFKQIIGRGTRLREDYQKLYFTIMDFKGATRLFADPDFDGEPVMIYEPKPEEPVVPPETIEALAIGEQELPPYVPDATGGAEVFPSGNTGGTSGEGRVKYVIDDVSVRVAVERSQYLDADGKLITEDYRVLLKDDIRKALQAEFGTLTDFLRRWNSAERKQAVLKELADHGVPLEILQQTVTNGSELDVFDLVAHVAFDQKPLTRRERANNVKRRDVFGKYGEQARAVLEALLDKFADHGVQDIEDAKVLELPPFDQFGSKTQIRRGIFGSVEQYTQAVQELEQALYDQNELKQA

SEQ ID NO: 31148 - protein, 374 aa, Pseudomonas aeruginosa
AIGCCSLVRTFSERSAFIQASKLGKEVFCTYEYCRRYGDLIGAQMTRLWMVRGESGSLYDAFREREVAAVGWSQLAPHATPGIGRKELTAKYQELEPQLKKGSVVAGASQVWRFVNEVAVGDWVVTYSPANRLYLVGKVAGEPEHHPEWAEQGMALTRKVQWQRQELPRDNLGTSTKNSLGSTLTLFEVPSDAAAEVFEALKGKPVTPKEDEAEESIADPLADVEAQALERIKDRVSELDWDDMQQLVAGILRAMGYKTQVSPPGSDRGKDIVASPDGFGFEHPRIVVEVKHRKGQMGSQEIRSFLGGRHKDDRGLYVSTGGFSKDAQYEADRASIPLAMWTLDHVVRALIEHYDATDAETKRIVPLKRLYWPA

SEQ ID NO: 31149 - protein, 80 aa, Pseudomonas aeruginosa
RICFAQIVGGFTIALSCSKQIRPYMVCGSRQPRHGSPFTSALMNLVCDSIDQRLARGIGEEENLIFAVGEVDLTFAIAVF

SEQ ID NO: 31150 - protein, 332 aa, Pseudomonas aeruginosa
FFLLQLLLASSPTCSKFCRGEIANRAVRSVFVVIPPPGLDADSRFGQRTEPVLIEAFVPELTVERLDEGILRGLTRLNQLQLDVALIGPLIECLAGELGPLVGADRFRVAAKPRHLVQRPCDTKAADTVLHQDADRLLGEVIDHRQAFDPPPGAQCIEDEVHRPDLVWCARQTQTFALHRDAMAAAPPFHHQAGSAVQAIDPLVVDLHASTPQQEVQAAIAKAPALLGQFHQLGLQLGVLHTGSRLVAQHRAGQPDQLTGTTLGDAGSRLHLLHRLPPCCRAYPFPRATTFSDSMSRWASASNFFNRLFSSSRSFNRLASATVIPPNLARQV

SEQ ID NO: 31151 - protein, 414 aa, Pseudomonas aeruginosa
PRLARPWSTAWRRARAACCWRWAVRMALHRSVSSASCCGSLSGWQAAARWSSSACSAAPRAATSLARSCRCSRRWRCCWCSRAAWARSRTRLSSSRLRRSGRCSASARASRSRNAWALASPCSSCSSAMCRSMRARRCSRGASCCWRARHCSRVMGVSSVFRRWASSCWASLRRSSAGALARAAKPWASRASASSRRAPSASACRVCRTAALAASGLASRAWSRALAFSWRRRCCWRDSAAWRMARSSRSARSRLRNSLSIFTCSCTSSQRSCSSQGVQAGAAGVGGGALGVAELGEPAGLVFPAREGLVQALQVALAGGDGFFPGDDSYNFRSAHWEASAAAVGWVSALGARAFSMAARSRARSLSPSWYQPWEETRWRCGIARRSTEGRQISRARARSSSGWQGASHSMPMA

SEQ ID NO: 31152 - protein, 272 aa, Pseudomonas aeruginosa
ATSCGSASRRRPRAGRLLWLPAMARCSCSSSSSPSQSASTFSLSRLSWRAAWRISAASRSPSSASKRCFSPVRITASSCSARGAWARPRARTWISRSCWLAWPARPVSSGPASVATVASPRLCCSAASCRRSGRHWRSRSQAPRRAARRLSSSASPCSRRKRRRRPRRSRRSGLSRASQVRASSTWRAWAWKRSRLFSSSMARAGDSSGACRSRSSWRSCRSICSASASRPSPRLGCPGVASRNSGSQWARRWRCSSRKFSRVPTWLASQAR

SEQ ID NO: 31153 - protein, 243 aa, Pseudomonas aeruginosa
RPSMPVSRLYSELCRDSALSRTSSCGLARKLSGSRLTARALRCSRWSSRAAAGRRALCSSLRSMRGVLLPMLMRTSGPRITAATTFFSKKSRICDTYCCFCGSSHCSGGIASSTRTLANGMRRSRRNCSAHSSTLGTPLRAKPLMRSSTRRYSSCRECCNRPRAVSASNRCTSASRARPAASSTIASAARNWPMLALSRTIRSSSAITRRSARASRPGCSVSGRRRWRSCHCAARRAREVDSR

SEQ ID NO: 31154 - protein, 207 aa, Pseudomonas aeruginosa
PSSGCSSSQPGVTISPRWISGISGFSSLSASISRKSSSSPSCWATWRRPASSLGDRPMCSAQVTIAPRSRWSRASAQCSAWAAARAKTVGLRKRRAPRAMLAPSASSFSLSAEAGASTASPFSQACTCGHCQRWWRSRASRPRSSRCNCGSRSSGSATPLASTWIRKALALTPSKQEPRVNCSSRIMPRLHQSEAAATPPAIASGAM

SEQ ID NO: 31155 - protein, 338 aa, Pseudomonas aeruginosa
GGFTAGRRTRLHRRVRQAAWALPPVAFSLSRRRNAGGFLLYTGDGGRRVAPLPASTPIGRSDMGYVTTKDGVELFYKDWGPRDAQVIYFHHGWPLSSDDWDAQMLFFLAEGFRVVAHDRRGHGRSSQVWDGHDMDHYADDVAAVVERLGVRGAIHVGHSTGGGEVVHYIARYPDDPVPKAAIISAVPPLMVKTEGNPGGLPKSVFDDLQAQLAANRAQFYQDIPAGPFYGYNRPGAQPSEGIVRNWWRQGMMGGAKAHYDGIVAFSQTDFSDDLKRIDIPVLVMHGDDDQIVPYENSGVLSAKLLRNGTLKIYPGFPHGMPTTQAEVINADLLAFIRG

SEQ ID NO: 31156 - protein, 414 aa, Pseudomonas aeruginosa
GRPMNLFDTLTLPNGSTIPNRLAKAAMEENMADAAQAPSERLMRLYQAWADGGAGLLISGNVMVDSRAMTGPGGVVLENDAQLEKFRRWARIGRSAGAQFWLQINHPGRQMQANLGQQAWAPSAVPLELGGMSRHFATPKAMDEAMIAEVIQRFARSAGLAERAGFSGVEIHAAHGYLLSQFLSPLSNRRSDAWGGSLENRARLLLEIVRAVRAEVAPGFAVAVKLNSADFQRGGFSADDAREVVRMLDGLGVDLVELSGGSYEAPAMQGEARDGRTLAREAYFVEFARDIRAAARMPVMVTGGIRRRPVAEQVLASGVDMVGIGTALAIEPNLPRDWRAGKDSAPQLRPITWKNKPLASLANMAAVKFQLRKLSRGRATNPRVSPLCALLAQQAGALLQTRRYRRLMRSRAEA

SEQ ID NO: 31157 - protein, 485 aa, Pseudomonas aeruginosa
KQSTGQTSTQSVCLQRMHSSSTTKVMIVLPGSGVRSGGRRQPFQARRHVLVPGRAGEEVALGAVGHLVGRHAPAHHLALGVAVVQALAVGQGDIARLHHVADLHFRLDLAAAGHHAQHLAVGAAQRLGVLRADAQGAVAPAAVPAGVAHGGIAGVAAPLAGGEDERVGRIVGWRAVGELGQFRQQFGDVQVDPLFGTGDGLPAFGVGGFGEDHPGRVVEHGLEQAVGGQRRQPVEAGAGSGLAVVQHVQLADAPDRRGRFHAGGQGRAEGTVEQDRRVFHDLGAGRRGGEESRRECLAPELQGQAQRPVVFLAEHAHGFQQAGVDLRFRQGAGARREQRRAQVEGVAREFQVEEGRLGLFELARRRQHVVGVARGLGHGHVDHHRQLQGAHGFAHALAIGQRMQRVAGLHQHGAIALGMVGEDFLWNHVAGNQADDDLGIGHRAALLDAWRAPLAHRGIALARLGQREEGHEGVAGAGAPVMAGE

SEQ ID NO: 31158 - protein, 133 aa, Pseudomonas aeruginosa
SCATAFSACAASMSFRPASGSPRQVLVDRLSRLVEAGALKEGALPEATAALRIPPHRHGPGPGIRCCWPWPIGATAGSTRAAAAPVEYVHKACGHKFRPTMVCPECGEPVGARDVTAVPGPGFAAMAGKLAQN

SEQ ID NO: 31159 - protein, 159 aa, Pseudomonas aeruginosa
AAAPAAECVGPFRGKGCGAARQTAEEHPMLSGSCLCGAVGYEIDAPIESASHCHCSQCRKAHGAAFATYGKVRREAFRYVAGADAVAEYHSSPGVTRTFCRHCGSNLQWLGGNEDPTYTSIALGTLDSPLPSVAQRHIYVGSKADWYVIADDLPQEHQY

SEQ ID NO: 31160 - protein, 409 aa, Pseudomonas aeruginosa
PALARRDQRTTDEVAAMLLNLFNEMRAAKVPVSVRELLDLIDALKHRVVFADMDEFYYLARTIMVKDERHFDKFDRAFGAYFKGLEKLDDHLKSLIPEEWLRKEFERLLTDEEKAQIQSLGGLDKLIEEFKKRLEEQKERHAGGNKWIGTGGTSPFGSGGFNPEGIRVGDAGKRQGKAAKVWDQREYKNLDDQVELGTRNIKIALRRLRKFAREGAAEELDIDGTIDHTAKDAGLLNIQMRPERRNTVKLLLLLDIGGSMDAHVKVCEELFSACKTEFKHLEYFYFHNFIYESVWKNNLRRSSERTATFDLLHKYGPDYKVVFVGDAAMAPYEITQAGGSVEHWNEEAGYVWMQRFMEKYKKLIWINPYPKDTWNYTASTGLVRELVKEQMYPLTLSGLEEGMRFLSRG

SEQ ID NO: 31161 - protein, 527 aa, Pseudomonas aeruginosa
QPWADPPGAGDDRRPGGSRPGRAVQVMADAHLHAGALEAPGGGLDPQLAAGHPLVVAQVFQPGFVDEKLQPQATVAAVLDQPPGHRAVAPTHGAHLDHRRLECRGVLRVDVVLEGDHHRAAFLVHLFVDQWCRPVQRRREVLGLGDRQPAAQRREQAEQQRGAGAEQGEGDRQVAGDQTPQGAAGGHAAEEHQDVDRQRAGADPGRHGGLRGDLQAGEHGDPCRAAEQHHRHQQIEVAQQRQGQQHQCVEHAGEQHQAVAAEAFAQARQERGAEHRADADAAQQQAEVHGVAMQFAAHDQGQQRHAGAGAEEERHRAHQHRLQWPRAAAVAPAGAQGAEQAFRRQHRGHGLAFPGQQHGDHREEGEGVEGEGQPGADQAHQHPGDGRSDRPRQVDPDTGQRHRRRQFVLAHQFRSGGAPGRHHQRGADAHAQGQAEQQPDAGQLEQGEAGQQGGHQGHPQLHAEQVAALVDDIGEGAGRQGQEEHRQRSGDLYQGHVQRAGGERGHQPAGAHLMHPGADVRGDAGQP

SEQ ID NO: 31162 - protein, 255 aa, Pseudomonas aeruginosa
SGRPREIICWPACCCAQQLEFIVRCQETIMSHYLEVLTPQNSQIIFIDQQPQMAFGVQSIDRQTLKNNVVGLAKAAKVFDIPVTITTVETDSFSGPTYPELLAVFPEQKILERTSMNSWDDQNVRDSLAAAGRKKVVVAGLWTEVCNTTFALCAMLEGGYEIYMVADASGGTSSDAHKYAMDRMVQAGVVPVTWQQVLLEWQRDWARRDTYDAVMAIAKEHSGAYGMGVDYAYTMVHKAPERVTHGERIGPNPAK

SEQ ID NO: 31163 - protein, 335 aa, Pseudomonas aeruginosa
ISPERLPRINLWGSFRASFFASREKCHEIIRRMESGGVMTVAIDRTKGDQSTPGNIIRGEGYALIRNSEATPDPDKVIHIPCADSFSVIVQLRDFNSHRLWNGNKLVFDGGHPRKSISIAYLGDEIKCQHRTTYDNVRFMLPRASIKEFLYEEGQRASAEPERIIGVDDPVVYHLALALLPSFARAGERNELFIEQVMLALLTHVQDRFASTQVPVCTGKGLAPWQLRRAKELIAGHLAEGVSVARLAEECGLSRSYFTKAFKCSTGVSPHEWLMRMRVDRAKELMLGSDEPLSQIGVACGFSDQPHFSRIFLRLAGASPSTWRRVKRQRTDAAL

SEQ ID NO: 31164 - protein, 227 aa, Pseudomonas aeruginosa
PPPGSPSASTNATSAAWRACGNAESIVARVEPGAAAGVCRPVSQAHGEAAYEDPIQRRGTGARRTGPARRSDAGGVRYRLVRPLPGRPAAAGGSIQRLPGGRPPEGRGRSRAPPGALVPGQAVADLRLSSRRPGGGAGGPPRQRQRAGRSVREPGRRGLRTRPAGRAAFRPASRDPPVRGSPGSAVPSACAARAGPGPGRSGVSRSRSPAPADAPPPAGAGRPSPPW

SEQ ID NO: 31165 - protein, 266 aa, Pseudomonas aeruginosa
RAAHGGAAGRIVRRGRRAFRAGQRAAHRRGRQVGGVPRCRGHAGATGLRPPGAGGRQRRVASGECRRHRRCLRCRPVGRRPAPRGTPACPARLAGFTGTQHRGGRRRRLHRHRDRHRDAGAPAGDPRRESGAASDRGRSRRRHRRIDGRGPERLDRRGLGGTGRGVVPGAFGGGGGCRGRDARRRPADRGEDRGLDRGRAGQHPDRADSGRARCPGSPACRPQPQGARSRRCLRHRRRGPRGYRRARQPCPDDLPARHRPGSLGRQ

SEQ ID NO: 31166 - protein, 139 aa, Pseudomonas aeruginosa
RTELRELTGLPSTRIRVFSGPMPRMSICRLLPRWPLELLPVRLTPGMVRMICDRSLLGGRLAMSSAVMMETPGACLVSSWAVATTVCSPSSMTEPSPWPAACTALASRQLDSSRKGTAGRAREDIGDLRAMQRNARDHK

SEQ ID NO: 31167 - protein, 205 aa, Pseudomonas aeruginosa
PCRPRASDGWRCAGGFPWPGPGCPGVPRRDSRRPSGRVAAPGPSRFRNRRHRAALPTPTAPAPARWAVAGARCPSRRGRGCLPAVVACRRFRDPGAGATVPAVARCRGRCAGAPAACAVRGTGCAAAGAAGRDSGAGARPCAPGPGPARPVRRGGPPAVRRGECFPVRRRAGRRRDRASGSAAPPGGDRAAGRAGRPAGSGLCRG

SEQ ID NO: 31168 - protein, 280 aa, Pseudomonas aeruginosa
RSGGSTPRRLAACCRGFPGAVRPAPPRYLPSPTVPCGSVRRPRHPRCARHPPPAARSPPGSCGRPGRGSRCCAPPTGPRCRSARSAAGRSRPAAAPVSITAGACASGVFRLHQQVALAAYRLDLQVTDGDRGEFAPQVADVHVETAVEARVAAVQHAPVEERLAQRLASVFAERRQEAVLGWRQPRRKALVEHILGLVVEHQPGIPPLRRRQAVQSYAAQQGVGAGIQLGQAERLRQVVVGAAGEAADAILFGAQGRHQHHRRGLLAAQRLQQRQAVEAG

SEQ ID NO: 31169 - protein, 289 aa, Pseudomonas aeruginosa
WRGRRAVRERAGLYRRRPGFPPLAVDPGAGGARPADRGGGRAQGRGDLDRPVRPGEGAFPLGPPRPVQREQLLLDARLPGLGGEELGLDPDPADRPGSDRQLPRRRPGPADHHRAGLQRRADGALRAAGERYPERHQEPFEQGRHAGQLQRDPHGGQEGRRAVVHPCREEPGHRGRERRDPLGRPRPDQDHRPRRDGACEARSHRDRGQQRDHHRACQPQQDGRPQRDGQDRHEQDGNHPHGLVAERRHGAHGKRRARLQPERRHDDEHRGRAEPEHPGDEEEDLVGGR

SEQ ID NO: 31170 - protein, 140 aa, Pseudomonas aeruginosa
AKTPACWSTPRAAGSAFLRWLPVPSIIPAARSCGCAAAVRAAAKRRPGAGAGRRCRPNCRRRRAPCWCCPATATCISSVAPTVSGACRPASAAPATAPSSAGADVACSPACATAPGAAMRWSTSKPASRARATTACVCSA

SEQ ID NO: 31171 - protein, 165 aa, Pseudomonas aeruginosa
PVPSATCAMPPRSATASAASNATSSPARVGSGAGPRWSGPTAAVASSTTTCSAAWSPCAIRWDGRRGAGAMARGGCSRRSRRARRAIASASTKRPGCWSSWRTRCSAAGPSSATNGAMRRRCAARPAAPATPTKTRACPTGRRESSTRAAASGAWSGTASACWPR

SEQ ID NO: 31172 - protein, 208 aa, Pseudomonas aeruginosa
PMARVICTARWSVRSSWPSSAMPCTVRCVATPAATGRMTRCSPRSASTRRWDACSAAACVWPAVSTGSAAIATTDLDNWSASTTTSIRRCATNTTSAVACWPAGALARRPAPTDTTPPATAWRASASTRARTLARHSPRTNCTAPVSVAPRCARTRPAKARRAGPATAWRGSPATAIASMRWATWSSVSAPTASACAWPTTARSAWSI

SEQ ID NO: 31173 - protein, 623 aa, Pseudomonas aeruginosa
RSRWKWSGRSFSMLPIRPLGSSAFIALRLCWSVHRASSGSVGFRKVLQMSSEAVSPGPQMTAEWIPLGQRLLERGLVSGQELERALDLQRRLGGRLGGILVRSGAISENTLMQVLAEQLRLPLVGDDLRKPSEESIAAFLLSTPINTDWFVEEQLVVWEEGEQLLFAAREPLSPSIRETLGYFYPERSIQAVLCRSQDLDGWLEHSLDLARQGADRHAYGSEDIRYLRELAEEAPVVELVNNVMSQAMEKRSSDIHIEPREFDFRIRFRVDGVLHDQLSLPRERFAAVVSRIKLISAIDIAERRLPQDGRMSIRVSGTELDVRVSTLPGVHGESVVMRLLPKEREGLRLDRLGMLPDHLRRMRAWVAEPHGIILVTGPTGSGKSTTLYGALEEINDGVRKLISVEDPVEYQVPNITQVQVHADIGLTFAAALRSILRQDPDVIMIGEIRDLETAEIAVQSSLTGHLVLSTLHTNDAVSAFTRLIDMGVEPFLVASPVRGVQAQRLVRRLCAHCAEPCEPTLAAADLAATQAATARLFPGQAAQWRVARGCGRCEGTGYSGRVGIYELVDLSSEMRDLIVQRASLEQMHRLAASQGQRNLREDGLIKAWLGMTSLDEVHRVTSG

SEQ ID NO: 31174 - protein, 410 aa, Pseudomonas aeruginosa
AHEFHLPGRRSQGQARSWRTLPPNAPGCAAAVAAPGAHPAQPGGETPQPGLATSAQGRGIEHGHPRAGHHARGGSEHGRRGGGSGARRAPPEVDYRPAGDGQWPAPGAILSRGAGERRPRLAALCISTGGGRRDDRKPRRSLEGLCHADGIRTANPRRVARGADLPCDSGAQRGARRGDPVRLRRSEIRQSPERDCPAPVACLGSAEHRGMEQREFRLAGVRRPAACWRHRRGAAQSGAPRPCARPVGAPARSRGMVDAGGNSAMVEGAWNPAGKSCAAGGGPAAFRRWRPHCPAAPDPGASHPGCAGRHRLVGSVGGAPGGHVHRFEPGAGWRGFRAARGDAAEPGDALWRGRAGANEKGPGTDRAFGDPADRLCVRPDHYRRGTGDYQRQRHGALNAGYRCRGWLDET

SEQ ID NO: 31175 - protein, 148 aa, Pseudomonas aeruginosa
SGNRMNRAAQQGFTLLEMIVVLVIIGMLMGLVGPRLFNQADKAKAQTADTQVKMLKGALLTMRLDIGRLPTEEEGLALLNTPPSDERLGAFWHGPYLEGGVPLDPWNRPYLYSDRPSAEQPFTLYSQGADGQPGGKGLDADVGYAPKR

SEQ ID NO: 31176 - protein, 202 aa, Pseudomonas aeruginosa
ERGGSRAVAATARWLDGYCSAADTLHGKRSLPGRKVAGPSWARDTYAAASAPSLRARDDPLMPARQEGFTLLEAVVALTLLAVVGGALFAWLNSAFRSMQRVEAAELRIETARVAMAYLERMNPALEPAGRARLGHYRLEWRSSPLSASKAAVGRHSGSPGIYDVTLFRVVASIRAGDGTPQTLQLELPGYVVIPARLGDGP

SEQ ID NO: 31177 - protein, 432 aa, Pseudomonas aeruginosa
SMCEGWRTVAGPSCICAAKLASAIWTVTASGTGTGRRARNWPIPFPRRWHWRLPRSACLSLSRSYCPERGPPNMISDGARRHAASARSSGFVLVGVVWFLAIMTLLASAAVLWVGRSLDATENRRKVLLRELEEHALLARVQWLVATQRYTVAGLSVPGNAGAAPSKVDMDTSILPIGGELPLDGREFCMANGWCVALLDRSARLSLSGIDPRVLSRLLAGLGVPAEQVQVMVAQWFSYLYPGAAPRLGSAAQASDRSSPGQARRRPLRSVMEVFRLEAWRPWEAHLLDAGWRDLVAADEAALNINTADARILSLAWGLPEDAVGRLLQARWQRPFTRMSDLHDVLGGHARLVPEDGWARLASPVLSIRLYPPGAEQGTEYEVRFNSEHRLLPPWQLLSKRSVKINDRYSNPPLHPDIAPGVLAAPLVARPW

SEQ ID NO: 31178 - protein, 402 aa, Pseudomonas aeruginosa
LPCPEPFLSQPTPARTMGSVAPGAGGNTHPGEPGCRAWRVTGPSLGRSGGGSNAAAMGALVAAWAHSHPVAGMRIQSGGRFVLVVGRACAANAVRPAERPGLADPQRTQPGLADQSDGHGAGARFAASLAGGAAGTGSGTVAEGQSVARLALSRLRAGVADWHRQCRPASLCAAFHGIGEFRRCQGGTFAERGAIAEPGPAYAGGGCLMSDFQRSLQFQGRNLQRQWQEKPLLRMAIWSLCLLLVVHLVMLSMDWREERGEEYRRLAGEWLKLQDVSRQTAWPERAMQAEQVLNLQRERFWQAPNASQARADVQAWLTERVRLAGVPDAEVSVLLPRGFEKQGTIARIEAQVRGQLQPASFSRLLQDIEAEQRQVSVEFLELNNMLSPMLNLQLSFLFVAAY

SEQ ID NO: 31179 - protein, 166 aa, Pseudomonas aeruginosa
SRWRSARGESGESIAPIFATAGASFVDADLGEFRQQRLELLPDPAAEVFAGGVFQAWNIVQIIVVELLVDRLEDRLDFREVADPAGMRIDLTFDVDGDTERVAVQAPAFVAFGDVGQAMGGFEGEFFEEFHCSALWIGVIGQPEWGRHGSRFARRTRSAPTGRSFT

SEQ ID NO: 31180 - protein, 98 aa, Pseudomonas aeruginosa
PWRRRGWRRPPGYPGRRWRSATDRGYPGSASPRAGRRGTADSPGNHGFPGGRGGLPPDRRRDRAGRSRRGSGSARGAPGGPRGADVRRPGSAGRGCPG

SEQ ID NO: 31181 - protein, 259 aa, Pseudomonas aeruginosa
SRPRSRCMPPAPRPMAAGAACGASAWHASRRRARKSPRSTWSRWTASRCWRSSRDSTSACGWTSTARKCAATIRFSAASNGREYRISVKREAGGRVSNYLHDRVAEGDELDLFPPAGDFVLRDSDKPLVLITAGVGITPALAMLQEALPQARPIRFIHCARHGGVHAFRDWIEDVSAQHEQVEHFFCYSEPRAGDSADAEGLLSREKLADWLPQERDLDAYFLGPRPFMAQVKRHLADLGVPSQQCHYEFFGPAAALDA

SEQ ID NO: 31182 - protein, 103 aa, Pseudomonas aeruginosa
SDGPARGASALFRKKEIEMNALFDCPRRVLRIGHGLLAAGLALLVAGVIAAYFLDRYLNMPALVFSHALVILGPTLLKIGYVMRLSALFRMRRPGWEVCCASA

SEQ ID NO: 31183 - protein, 425 aa, Pseudomonas aeruginosa
SFQADGHTADLAPGLPPVLPRRRAVRGPRHRALASGAGRALERLATGRWLAGLASSRNALRFRRGDHRRLPVDRRADLDRRTRPAGQTPGPARRALAGGAPGLAIRCAAGAAAGAATELPAAIGLGYRSQPVAGAAEAQLPGGGPVAAVDPGRRPGPARPVRGQRRLATACLHRRAMADRRDDEPDRRAGDPVLHPPRSRPSAAGAGDRLAGQWHPAGLRAGGAAHRRGRHDAADALACRTVRRPRWCATVAPVALARSRHLAGAAALVSAPGIFLDRRGAAWHGALEPGPGAGAEPGAARAGGGRHGRVDPGDAGTGHSRPYRSRAATAGSDALGFRSAQSRLRGAGVPAQPVAGELGAAPGRRTVGFGVPAVRLVLCADAVSSAGRRPSRLIRGLAADAAAPGSASRRSCASAWRSAPGRACR

SEQ ID NO: 31184 - protein, 241 aa, Pseudomonas aeruginosa
TGTGCPQRPHPEGRGRRLMRLLLVEDHVPLADELMASLTRQGYAVDWLADGRDAAVQGASEPYDLIILDLGLPGRPGLEILQEWRGLGLATPVLILTARGSWAERIDGLKAGADDYLTKPFHPEELALRIQALLRRAHGLANQSQLEAAGLRLDEQRQCVCLNGADVDLTAAEFRLLRYFMLHPGQVLSKGHLAEHLYDGETERDSHVIEVHVNHLRRKLGREVIETRRGQGYRYAGVAAG

SEQ ID NO: 31185 - protein, 738 aa, Pseudomonas aeruginosa
CCRCWCSCWASPVDSERRGGRRGYPRRLATSRPWKTRCAASAASRDRPGQRQRRWPRREPRRVCVAGCARWPAWRSGGPTAPRRYSGRERSGLELFHQALLVVGQAVQRLTDLGRLLGLARQRLGDVTDRRDIAVDLLGYRALFLGGAGNLQVHVVDHRHRLADPLQRGHRFIHLLDAALGLAMAAMHGVDHVAGALLQAFDHPADLFHRVLGAPGEVAHFVGDHREAAAGVAGAGRLDGRVERQQVGLLGDGADHFQHRTDFLAAAGQLLDLAHGAGQVGGQAVDALCGAVDQRQAVAGRLVGTARGVGGLGGATGDVLGSGGHLVGCGGDLVDLAELLLHAGAGLAGNRRRLVGGTARIAHRDLHVADDRLQLVEKTVEPTGQFAQLVAPGVRQTLGQVAFAAGDVAQHVGDAEDRPGHAAGAQPQHQQAEHRGAEAEAQFDPGAFATHVVQLPLQRQGRAEQGALRHFEEHAPGLGAGNRLQRLQHLEVVVLVEQPALAGGQQLQEFAGVLRIRLGQVLAEQAGVAAVAGEQPGRAEDADLADAVIEFAVALFAERLQVAQVDVQAHHADHLAIQFEGKGDAGHQQLAFADLVEVRIEHAGLPAFLRAGVPGVVGRAAGPAAGVGEFGLDHRLGFQLSRRGLRPVQGEASLVVAAQGRLVQQQFVLAVQRIGFEDHVLAEHFGIGGERGAHLAGQVFAQVVGIEEALLRLVAEEQDLPGEALAVLEGIHEIALDA

SEQ ID NO: 31186 - protein, 479 aa, Pseudomonas aeruginosa
PGDIRACAALTGGDGCSRVRPFFRPQTVEFVSFARSSTMNAVVLAVGLMLVLSLCRVHVVLALIIGAVVGGLFGGLGLEGTLKAFNGGLGGGATVALSYAMLGAFAVAIARSGVAHALADKVLALLGRHDEQGKGAGAFKWILVGLLLCVAVSSQNILPIHIAFIPLLVPPLLYVLSKLQIDRRLIACVITFGLITPYMFLPVGFGNIFLNEILLANVARNGVDVSGINVTHAMFIPALGMLAGLLIAVLFSYRRKRVYDLQRIEQAERVDVSYNPKSLAVAGVSIVAAFVAQLWLDSMIIGALVGFVVFSLSGVVRWKETDDLFTEGMKMMATIGFIMIAAAGFAEVMKATGEVQSLVDASVAWIGNSKAVGAMLMLLVGLLVTMGIGSSFSTVPIIAAIFVPLAVQLGFSPLAIVSIVGTAGALGDAGSPASDSTLGPTSGLNVDGQHNHIWDTVVPTFLHYNLPLLVFGWAAAMLL

SEQ ID NO: 31187 - protein, 649 aa, Pseudomonas aeruginosa
RARGQLHRPVAAACGGDLFGADRSRPFAVTGGLGVPTGAVVSQDVDFVEGGHEASGFIHGARSMPRQRGRVRGAGQRKTPPRRGFRGAGDSAGEGQAGMLEDFQQRLRVDAEEERQQGDGHQHDAAGALAPVERCVVLADAGLDQEQGDHDPQVVVQADGAAQHQGADQPPQVRLDADRDHVELADEAGGQRDACQRQHHHGHHRGQYRPAPEQAAVLEQRIGVAAAVRGGHQGDHAERAEGGQYVGGQVDADRFHGHALAGDQGDQQVAQVGDGRVAEQALDVALGQCQQVAEEDRGDRDDAQGDVQQLVVQGRRGDLEQPQQHGEHRDLAGGGEERRDRRRGAFVDIRGPQVEGHQRQLEAQADQHHAYANADQRTAQHVLGNLGAKAGEAQGTGLGVEQGHAEQQEGGPGGREHGVLDAGFQRALVEEGVGDHPVDRDREQLQADEQAGQVLRADQHQAAGGGQQQEQVQLFAVTRIAFHVGVGEGHAGQGGDQHQGHVEAGVVVHQHQRCHLDRGDAEDRQQRQQGQVEADHREGGGERVIAFPGYRQHHHHQGGAGDQQWQERDEVLNRKGHFATTVLQGWKGLRPAIAARRACWPRRCPALAAGRPRAGPAGPPGRAPCSVRGHRGRGSARRTGWGRSRRGGS

SEQ ID NO: 31188 - protein, 271 aa, Pseudomonas aeruginosa
TGRGNGRSGRRRRSPWWRRGSARKTGVGPAMASAIQVCSGSWADLPTAPPSQGQGRQGQPEVAFRELLRRQHQQLLDVQGAELLEQDEQAESHEHVADAGDDECLERRVTVVAIAVVEADQQVAAQAHAFPAEVEEQQVVAQHQEQHAGDEQVGVGEEARIAGFATHVPGGEQVDQEADAGNHAEHGYREAVQVQGEVGAEVAGRHPLPQHQAVGTAFRRTAVEAEDGPGRAQGGEADRADADQRRKVFRPPAAGERQQQEADQGEQEGKR

SEQ ID NO: 31189 - protein, 305 aa, Pseudomonas aeruginosa
SRWFSLLGRGQHERAGHQQVDQGQRQAHLPAERHHLVIARTRQRGADQDEEHDEEAGLGGEVEERQPAQGVQERTVPAAEEQGRQQPRDQYDADVFADEEHAPFHPGVLDVVAVRQFVLRFRLVERVTVGHGDAGDDEGAEAEELRNDEPDVVDLVLDDVAHVERADLGDDAHQRQGQEHLVGDGLGRGAQAAEQGELVVARPAGEQHGVHRQAGHGEEEQDADVQVRHAPGGGDRHDGEGDEQGAHRDHRGQGEDHLVGERRGPVLLEEHLDHVRAELERTERTDPVGAVAVLPEAEQAALDPA

SEQ ID NO: 31190 - protein, 100 aa, Pseudomonas aeruginosa
QGAADDHGEQHHDGLDHGEDDGDQSGSQPTHCAASCRPSTEQPAIAAGMPAKPTGRPIRPAPSCSSIRSGRRRAWPLSWKPRVAPSLTPRRSASSLDRAT

SEQ ID NO: 31191 - protein, 175 aa, Pseudomonas aeruginosa
GSYVGLQQFGDTVGTHVAMSVVVDHQRRGLVAVAQAADREQGEASVGGSLAETDAELLLDLADHRLVAADVADHAVADADDVAAHRLAEYLTIEGGDAFDVAGRDPQHLADRRDGAVRHPAALFLDDLQGFDGRRARVLVVMHFMLDGRALGFAEDETVGLNQVALAHVSGPRQP

SEQ ID NO: 31192 - protein, 114 aa, Pseudomonas aeruginosa
PCSGRRRRRCGPAVPRTRSSRSRSRGGPCAGRSRNRWRAGRRRWCPTRGLPWCCTGRRRWSGRAGCCSSGPRSRTRRGAWASSRGTRGPACPSRAAGRGRRRRCGTRPGAGGSR

SEQ ID NO: 31193 - protein, 321 aa, Pseudomonas aeruginosa
RSRRQSGNSVRRRYPGRLPCKAGCTERSLQSWSRSLSVNGGVNAAGLGRPAGLAGSSGSHFVGAAQVGHLDALLAFQVFLGRHFGAVDPLVANDPGQRAALLADGFLQQHQALQERLRTGRAAGDVDVHGEELVDPLDHRIDVVHAAGIGARAHGDDPLGFEHLLVEALDDRGHLDEAGAGDDHEVGLARRRPDHFGAEAGDIVRRGEGGGHLHVAARQPEVIGPERVLATPVDGGVQHILELAHEDVLVNLALDQRVGYGFPFAYRVLVVGRIGIDPGKFVLHRQSLIVLASPAACDGFREPNRAHRSAKDRQDPPTELL

SEQ ID NO: 31194 - protein, 736 aa, Pseudomonas aeruginosa
RGEPAFHPLCPGLPTAVAATCAGIPANAGRRGASEQASAVFAGDHHGGRAWPAARPVRPGAEEVIGGRAFPRVLDVDEQRTEVRRRGNAGHLATQRTGEEALQFAGARVGHQHLVVAERAAAQLAAAHVGLDPQAAFRVEPEAVGAGQDIVLVQRLAVRAAAVFAGTGEHEQVPGEALPGIVAAAFAPADDMAVGVLHPWVGGVGDGARRVVGEGEVDVAVVRVDRAPLRAIHLGRAEDIGGQAGVDQHFALVGEAHPGLATGRAEVAVGDVQRQPLAAAIGVEAGDVEGTFVEQASVAATRTELVAADVLVDVLVLRVVAGVADYLAARLDRGEDQAFVGEAAESGALDRYRLRVERVDLDDPAEVVRFVAVVVLSLFALAGGVEALELVARQGLPAETAGVANAVAGQFARQFAVLGGEIADPVLLAGEVGAPGGETVGTVVVGAAGAGAVRTVAGAQQFVAARRAGDTHRRGGGDPPIALRRYDIPLATHVATDLHDGNAMGVDFLAHFIGDGALAIDHGRAIGVQQRRVDVFMVEHQQAMVADVSAAEAELRVDREEVHAVVVHADLFGLVLGAVAGVVEESRITAADRGAPGYEGRRLVAGGHPDGIGAAAGDGFEGQAVAAFERQAAQAFRGGRLRFGGSGAGGERDAEEGEGAERRAAGQDLAAAEAGDQVVHVRVVRMVAGQLVAITEQDGIFFLQAHGRAPCGLIDGALTLTAESDGTMTGTRGLLP

SEQ ID NO: 31195 - protein, 717 aa, Pseudomonas aeruginosa
NKNARRSRACKRVACSDALGLGGGIADVAGRGQLLQLDLGLGGNRQLFDESLQGFGADAFAAGQFLQLLVGVFHAIATHHGLHRLGKDFPAGVQVLGDALGVQLQLADALQAGLVGDDAVGDADAEVAQHGGVGQVALPARDRQLAGQVLEQRVGDAEVALGVLEVDRVDLVRHGRGADLAGHGLLLEIAEGDVAPDVAVEVDEDGVEAGDRIEQLGDVVVRLDLGGVGVEGQAEVAFDELAGVGFPVDFGIGGQVGVVVAHGAVDLAQQLDAGDLLDLPLQAVDDVGQFLAQGGRRGGLAVGAGEHRHVGEFHRQFADGLGDLAHQRQQHAVATLAEHQGVGQVVDVLGGAGEVDELADRGQLRELGGLFLEQVLHGFHVVVGGALDFLDAFGVFQLEVAGQAVEQGVGFGGERRDLGNPGVGGEALQPADFHHDAETDQAVFAEDRTQAAGFAGIAAIDGGYRGERGKLHETFSWLEVNEKGAHIIHERCAPVGHSAGPFGGAVAQQGDQAGGENQGGAEQRRVAGQFVPAQPGDHPGENDGHVGDRSDHSRGGQGIGLRHGQLAEAGEQSGAEQQEQFLAVQRLPGPGQRHGGEQGAEQGEVEHDAIGWLAVAHFADRDEGAGSHQAGGDADQGDRRHYRAAGPGHQQHAEEADQGGDHHAAGQRLLDPQVCDQRREHRRGIAEQHGVGQRQVGEGVEVAVHAAQAVGGAQQVR

SEQ ID NO: 31196 - protein, 452 aa, Pseudomonas aeruginosa
CARLFRLRKMWFPGGQLGYPRRLQQGFNHNTEFSMGYQKIQVPATGDKITVNADMSLSVPKNPIIPFIEGDGIGVDISPVMIKVVDAAVEKAYKGERKIAWMEVYAGEKATQVYDQDTWLPQETLDAVRDYVVSIKGPLTTPVGGGIRSLNVALRQQLDLYVCQRPVRWFEGVPSPVKKPGDVDMVIFRENSEDIYAGVEWKAGSPEAEKVIKFLTEEMGVKKIRFTENCGIGIKPVSQEGTKRLVRKALQYAVDNDRSSVTLVHKGNIMKFTEGAFKDWGYEVARDEFGAELLDGGPWMQFKNPKTGKNVVVKDVIADAMLQQILLRPAEYDVIATLNLNGDYLSDALAAEVGGIGIAPGANLSDSVAMFEATHGTAPKYAGQDKVNPGSLILSAEMMLRHMGWTEAADLIIKGTNGAIAAKTVTYDFERLMDGATLLSCSEFGDAMIAKM

SEQ ID NO: 31197 - protein, 132 aa, Pseudomonas aeruginosa
LSRKAKLFFLMHAPSQIRLTFNQDHPEPHEHEDEGAGLAVQESKPVLQPPPLYKVVLFNDDYTPMDFVVEVLEVFFNMDREKATKIMLTVHTQGKAVCGLFTRDVAETKAMQVNQYARESQHPLLCEIEKDS

SEQ ID NO: 31198 - protein, 767 aa, Pseudomonas aeruginosa
SDVWERGEAMLNRELEVTLNLAFKEARAKRHEFMTVEHLLLALLDNEAAATVLRACGANLDKLRRDLQEFIDSTTPLIPQHDDERETQPTLGFQRVLQRAVFHVQSSGKREVTGANVLVAIFSEQESQAVFLLKQQSIARIDVVNYIAHGISKVPGHAEHPQDGEQDMQDEEGGESATSNHPLDAYASNLNELARQGRIDPLVGREHEVERVAQILARRRKNNPLLVGEAGVGKTAIAEGLAKRIVDGQVPDLLADSVVYSLDLGALLAGTKYRGDFEKRFKALLNELRKRPHAVLFIDEIHTIIGAGAASGGVMDASNLLKPVLSSGEIRCIGSTTFQEFRGIFEKDRALARRFQKVDVTEPSVEDTYGILKGLKGRFEQHHHIEYSDEALRAAAELAARYINDRHMPDKAIDVIDEAGAYQRLQPEEKRVKRIEVAQVEDIVAKIARIPPKHVTTSDKELLRNLERDLKLTVFGQDDAIESLSTAIKLSRAGLKAPDKPVGSFLFAGPTGVGKTEVARQLAKALGVELVRFDMSEYMERHTVSRLIGAPPGYVGFDQGGLLTEAITKTPHCVLLLDEIEKAHPEVFNLLLQVMDHGTLTDNNGRKADFRNIILIMTTNAGAEVAARASIGFNQQDHTTDAMEVIKKSFTPEFRNRLDTIIQFGRLSTETIKSVVDKFLTELQAQLEDKRVQLEVSDAARGWLAEKGYDVQMGARPMARLIQDKIKRPLAEEILFGELAEHGGLVHVDLKGDELAFEFEITAAEPA

SEQ ID NO: 31199 - protein, 92 aa, Pseudomonas aeruginosa
GRAGLPRVRSMVVEVFFGIQRGHAAGAGGSDGLAVDVVGHVAGGEHAFDAGLGGIAFAAAVDPQVAVAHFQLALEQVGVRLVADGDEHAGQR

SEQ ID NO: 31200 - protein, 407 aa, Pseudomonas aeruginosa
PGAECRRSARCGIRRYPVHDARLLRLPLSAVAGHQDLAGIPPPQPAVGMEHLAVFLAPGRADLPDPGRLGTGLHPFPRQRPHAGQRLGRRRHRPEPGPRRGGCAERAGQHAGVLRPVPLRPDGVRRPLLVQGDGCHRQDHPGLLRTDPERLQSLDGRARRAQATGRATARGRRARRRGGGAERAGPPRTVQGQGAPAGTRRGPGQAHERAGEAPAAEDRSATAAEGPGAEQARAEREAGAAVRRYGGGGHPAAAVAARPGGSEAEELLARVAGGDVAPAGDQAEGVRRRGQRGFGASGPRDHPFRDPARGGGQGQPHFQPGQGPGALAGGDQRAGGGSDSRQDHCRHRDSQRRPADGALLRSAVVAGVRRAQVHRAAGPGPRHRRSADHHRPGEDAAPAGGRYHRLR

SEQ ID NO: 31201 - protein, 338 aa, Pseudomonas aeruginosa
VGGGQRHAPVDPVQVHAERGATDHDRPEDARTVDLRRDPAPALPGGHRHEGSRQRPALERGGDGAALPPDGGHGCAQPGWLQPQGEGRRGGWHAADRPAVPSRKPGRRAAAAEHPADHRGGGRRIRRHDDDRRQEGRGAYRPYRAEGAGGRYPPDPGDPAAVGGRDHRPDQGQHPDPDRLPGLQQDRLAHHPRPGWRRTTSRPRRHALPAAGHRPADSRARRLRFRRRGAPGGRGLEAARRARLHRGHPRWRRRRRQRWRFLRWRRRLRRRQRGRPALRRGGTFRHRESPGIDLRRATQAEDRLQPRRADDRGDGDGRRGHPDEYQRLPRSHRAGAGS

SEQ ID NO: 31202 - protein, 162 aa, Pseudomonas aeruginosa
TCWRTLPTSPRTAARSAPSCCRICSAIPADVSTRAARRSTTRSARCTSRCAAPIPTRHFIGSRVCSTAAAIPCTSPGGWCAWPARRLATPILAPSAYACRPGTCRSAWAAPKASWRWPRPSSTWPVRRRAMRCTARSTRRCATSPKAARGKCHCTCATRRPN

SEQ ID NO: 31203 - protein, 490 aa, Pseudomonas aeruginosa
RSATSWNTWPSWIAPVPANAENPERYGLGGASQASATASMTSPGPAKRQPGHEPPITDTRREKSMLDPKLVRTQPQEVAARLATRGFQLDVARIEALEEQRKSVQTRTEQLQAERNARSKAIGQAKQRGEDIAPLLADVDRMGSELEEGKRQLDAIQGELDAMLLGIPNLPHESVPVGADEDANVEVRRWGTPKTFDFEVKDHVALGERHGWLDFETAAKLSGARFALMRGPIARLHRALAQFMINLHTAEHGYEEAYTPYLVQAPALQGTGQLPKFEEDLFKIGRDGEADLYLIPTAEVSLTNIVSGQILDAKQLPLKFVAHTPCFRSEAGASGRDTRGMIRQHQFDKVEMVQIVDPATSYEALEGLTANAERVLQLLELPYRVLALCTGDMGFGSTKTYDLEVWVPSQDKYREISSCSNCGDFQARRMQARYRNPETGKPELVHTLNGSGLAVGRTLVAVLENYQQADGSIRVPEVLKPYMAGIEVIG

SEQ ID NO: 31204 - protein, 312 aa, Pseudomonas aeruginosa
HGFPAAVPLLARAPRAGGRWRRSRPAQGAPAGRRRRAPARGRAADPHRTAASGGAGRRRAARTRLPGRRPARLRPDHRRHRRRTAERRGVASGQCARDTGQRGGRAGPVQRDLPGHRRPFAAGGGGLQRRRCARAGAADPGQAGNLDSLDLRATGRTRQPLPPPGQGIATRPAAAPGVLGKPVPGRDRRACPGRPSGGSRASPGRASGRRPRAHSHGRGISGRGRAGGSGPADVPCPAPDAAGRRGALRSPGGAVDPRIMPPRCRTPVRRQAPRRTCGAAGSDQPPAGGAGQPGQARAAPEGRRPVHLRPRR

SEQ ID NO: 31205 - protein, 139 aa, Pseudomonas aeruginosa
KPSKGRLFREFESHRLRHIRVLKSPAERGFCIFGAPLFRTSGSFPQPARRRFDDSPISSGNGFRSRRSRGFRRDRVAPPGRTPSPGSPASLRADCRYLRRGGGSGQCAATPTGFRRLPSAGPRRPRRWCRRREGTPACR

SEQ ID NO: 31206 - protein, 152 aa, Pseudomonas aeruginosa
SRRRRVRPVPRPASPSGPARRRSCWRVRHRRPPVPGARRARWRHGRFPEPAGHRAWSGSQAGDRLRIPRACVRRAGRWCGRARPAIGPDRPGRGVRRRRGRRRHGRAGRRPCVCPARSHRSVASGRVPVADRPASSRWCRCVMPPPGWGCRR

SEQ ID NO: 31207 - protein, 195 aa, Pseudomonas aeruginosa
SACRGAAPGHGSPVPAWTAAGWRRTGDGPGRTGPPRARRAAPAPGGRGERRGYRGRCVRRSGSCGVLFRQVPDIGQAAVGIAGNEGFFLTFGAEHGTPYRTDIGAVDVDTDGCAVAEGVAHLVHVANAWRQRFDLAGLQASTGSAGMRTPPRIEGVRLRVFGPAEHADQAPDPMIVYRCDLARPPDEADHREALP

SEQ ID NO: 31208 - protein, 94 aa, Pseudomonas aeruginosa
PLPRSVAGAATGGFPAADPALAGASAPAGQSGNAGTAVRQGGGRGVGYASRLSSGAGRSPGDGSVNEKGLQSGSTFPCEPLFASEGRGSEGCYA

SEQ ID NO: 31209 - protein, 714 aa, Pseudomonas aeruginosa
PYRPPAAVAARRLRSSDETQAIPANQLRHASARCLPGPGRRAADVACGRPELLQRAGFHGGLGSSRRRALPGRMEAFPVRRAGGRRVAGRSAGPGFPRRLGLHLPRRQGCAGEAGRRLAAEPRYHSPAGAEGFSGAQHCRSQGQESRLLARCLEPATDLARAGESRPAEGLRGVRQADADRRRRRLAARQHRCLSGVGAVYLAADRGFRRTADSHRPRPDAGAVQHRRQRCFHRAQARADRRLPRPPAQGTGLGRGTQGAVRRPLGAEGQSRPGSLPPLDRPGRHERRPGIRPGRHRLPGDRGFPAADRCLAQAVRHFHGDRHVFQRSLPLSTDHEHPVSRHDRPSPGLGDPRAGRTYPRQALHRRFRTRPRRGRLRSNPGRLLVGPAGWIPGGRRRWPGHFPDRSAAGAPPRFRRPDPGRAQAGDPRTPPRRAPGGAYRQRRQRRRPAQGRRLSRPRPALCPQRRIHRTAQAHLDQHRTLRFPRRVLPRGARLLGHPSAAETAHSGVFRRLLGSRAEGRRQAGRCVHALGRTPGTGRRNHLRCARTGALEWSRSGVQPVVPAHPRAHGGRGLGQGRGDTRKRRRAPGRGRLPQGQAAERRRPASAQGGGAGRAPRRAPLDRNRQAGRWRAQLHRPGRYRGTGGRRPARLLRPGRAQYPHSRFRSPRRCRGIWPRADPADPRQSRRARAPARHGLIPWPSCRLPRRRSTNGCRN

SEQ ID NO: 31210 - protein, 175 aa, Pseudomonas aeruginosa
PGWRYGRAATSRSPAWVPGWCAATAQASVSWRAGTIWACAPAAATRCSSKRWRCLWKTPSACIPTTSLRRRTRPCCATSPRLARCCLALSTTVSPGAPASGSSAGCASACRPVSARRWRACRGCRRRSARSTACSCRTACCSMPRAADSCPPATPGCSRSRSSTTRWRWSRRPWN

SEQ ID NO: 31211 - protein, 290 aa, Pseudomonas aeruginosa
TCRAKSLGAGLARRASVLWSSVRRLPPPCRPPPISSMPKACCRSRWRSPRRSTSACPPVPPKWPASCPPTSASASVEELRNASDPEPVPASLPARRPGLCRRARDPAPGRPEGQHARPVGGCRRAGRPDLRHPLVRIPRRRPPRRSTQCRCGGCRHHRRRAIALRPGRRCPAEGHRRRQIRSLRYRRAGERGFAAALGQRPERSAHCHRARFHRPLRRAQGLGLGRAGREGRRIPLPRPGGRENGPRQWFRGCLGDLGALHRVRGDRRQGSGTGRRSRPVGWQQLPRCYR

SEQ ID NO: 31212 - protein, 62 aa, Pseudomonas aeruginosa
RTGRPGETRRAAGLPATPGQRPALGVPAPGRVFAKPGADHRLPRGRRALAVRTPALALAGAG

SEQ ID NO: 31213 - protein, 429 aa, Pseudomonas aeruginosa
AWFSPSGMPGAFPPWGRGISIGRRSAGKPHPDGRGRASPGERRERRSWRTSLDFSGSGRSRASRGRLGRVSAPGLDPAPDPGTDSLDLQWQGFQREEGRHGFLAQVNRRVFPQLPLYQRQRRLVAIRIAHVVGGPGDDLRTQQVVDQRITLLRMRCILEQHHVLGPDQRAFPGNAVGDMATVPGLFVVDLGHVGRTLPADHHADVAVGEIGVDSGGVEIANVGANLQQQFLGFLVVLGILAVVRQAQVVEGDGHQLGGGVQRGHAALAEAGDVLLLEDQVPGVDRRVGAEQLADLVHVVGDPGGSPEIRYGIAIAGIVGLKLPEDVRVEVLPVGEPVAVEFLEDARLDQPGQDVGGDHHHVVAGAADHQFALRGLGAVEGVEDDTGAGFLLESLGRFRGDEVIPVVKMDAGLRSPCTVRRCRTDRRQDR

SEQ ID NO: 31214 - protein, 301 aa, Pseudomonas aeruginosa
KSRRRIALMGEFHPGRFDHARCTSFLSFVDPRALCGGARLRAAGRGAGRRRWAARRGHGAPGIRHSARRTGRGVVEHRAPGTRADRLRPAPGGGVARTGYPRPAQCRGRLAACPGRQRAGIRAGRKRCLRPAPRTGACAGDARCGGGTDLVHRGGHRHAQERCEGAGQPEPDRCGQRYPATQQRCGRPARCAGQTAALADPPGPAVQRLGVDPHAVAARAEPQPCAGAGERQASPRNGQSQYQRRAGEGLHRGRSGHHPDQRHRTCRGAARRCFGTVRFGRHRRGDQRHPQVRRQRRVGGR

SEQ ID NO: 31215 - protein, 435 aa, Pseudomonas aeruginosa
NRQQPEKLRPGALPQQPMDQQPGPGARIRTGFPRCSAGRCRWGAEYRRESYRIDAREPASYYSGGAESLAGLSPLSEGQWSRHAWASYLDLGTSLTPAWEVDVAVRHEKFSDFGSTTNGKFATRYQFDPRVALRASVSSGFRAPSLVQEHYTGLSVGPTIALGLLAANSPAAKMLGADELQPEKSTSFNLGLVLSPWENVGLNIDAYQISIRDRIVDSATYSGQEAIDALAAAGISLPASASTVSTHYLANGADTRTRGVDITGHYLVALGEYGQVDWELSANFNRTTLRKNHRGANGEPLLNAQQVAWITSSTPRSQVSLGGTWSRQDWEVSLRLTRYGRTSSELDYTVGPDAWSTEKFNHFVNDPKYITDIAARYRLSADLTLTAGADNLFDVRPDKLPAQNTTYGDVLRYDTYASQIGFNGAFYYLRAAYRF

SEQ ID NO: 31216 - protein, 220 aa, Pseudomonas aeruginosa
CATRCSVIKVLVVDDHDLVRTGITRMLADIEGLQVVGQADCGEDCLKLARELKPDVVLMDVKMPGIGGLEATRKLLRSQPDIKVVVVTVCEEDPFPTRLMQAGAAGYMTKGAGLEEMVQAIRQVFAGQRYISPQIAQQLALKSFQPQQHDSPFDSLSEREIQIALMIANCHKVQSISDKLCLSPKTVNTYRYRIFEKLSITSDVELALLAVRHGMVDAAS

SEQ ID NO: 31217 - protein, 608 aa, Pseudomonas aeruginosa
MSAVFDASAFLATCSNRPGVYRMFDADAKLLYVGKAKSLKKRLASYFRKSGLAPKTAALVARIAQVETTITANETEALLLEQTLIKEWRPPYNILLRDDKSYPFVFLSSEDEYPRLSLHRGAKKRKGRYFGPYPSAGAIRESLNLLQKAFLVRQCEDSYFRNRTRPCLQYQIKRCKGPCVGLVSPEEYAEDVRHSVMFLEGRSNALADELNVGMEQAAMRLDFEKAAELRDQVAILRRVQDQQSMEGGNGDVDIVAAIVTPGGACVHLISVRGGRVLGSKNFFPQVAIEEEVGEVLLAFLGQYYLSHQERDLPAELIVNVTHEDFPVLVSAIAEARGRELEISYRVRGTRARWQQLAVTNAEQALGARLANRQHVAARFEALAEALDLAEPPQRLECFDISHSSGEATVASCVVFGPEGPLKSDYRRYNIEGVTAGDDYAAMHQALTRRFSRLKDGEGKMPDILLVDGGKGQLAMAQDVLQELAVAGLILLGVAKGVTRKPGLETLYLNDASHEFTLPADSPALHLIQQIRDEAHRFAITGHRARRGKARRTSTLEDVPGVGPKRRRDLLKHFGGLQELSRASIDELAKAPGISKKLAEQIYAVLHSE

SEQ ID NO: 31218 - protein, 197 aa, Pseudomonas aeruginosa
NAGSPRSLDGPMNIPNLLTLLRVLLIPIFILLFYLPTSWSYLTASAVFALAAATDWLDGYLARRLGQSTPFGAFLDPVADKLMVAVALVLLVEEHANLWLTLPAVIIIGREIVVSALREWMAELGARAQVAVSNLGKWKTAAQMLALVILLANPPLMTFWVILGYVLLIISAALTLWSMVHYLLAAWPHLSTTPKEK

SEQ ID NO: 31219 - protein, 464 aa, Pseudomonas aeruginosa
PLHPDQHRRGEEPAGAAGHPGEGAAGDRSGRSGGNPPPLGASLRQGRGGLLARSPEQDSADRRIVRRTDFHLPHLGFLPDAPGAQDPPGRRASRRCQPCQERVSFDDESRDPHAIECGHRPAGTGAEKGREGRVGPRFAEHCPGGRPGVAASAGQYSRFVADRIRSVRFSSRISASWRVDQRNPAVGWWADAAEESFPGTGTRRGSRALGAGGSPAFQAGVVQPAGQCHQVHRARRGNGAGSGAARGGEASFAARGKRHRPRYFGGGPGQAVPAILAGRLACAWPGVRQRPGVVHQPTPGAPDGRPDQPAQRTGQRLLLLGRVRSSADRASAQRVQRSAFRSCRGRGAERGKGALDIACGRPSVQSADPDHAIGKPWAPGDLHGRWRGSIRTLAGRRLRRRDYRRHDAADGWLRAGATDPVARSPWRSASLLGDSAYRQRREGCAGALPGCRHGPGPVQADYAR

SEQ ID NO: 31220 - protein, 108 aa, Pseudomonas aeruginosa
CTTPCAPTSWRRSWSSPATARRPSRSARTCRSTASGFARWSSRTRGCLSTTPSTRRWSSCGPTWKPTSAPPRASSARRCSIPWRHGPSCRSSSRPSRSWKGATKRSAA

SEQ ID NO: 31221 - protein, 154 aa, Pseudomonas aeruginosa
RRRAARDVLGCPFAGRTQGMEHPYKTPEADLAEEKLTARGFLSGGQPLWKAFWLFFAAGFLLLSVAARQAMVAIVDPLMQEAPGEHAVALTLWGMVGVELVRLAYLCLSLVVVWRCGRNSRWAAARHASRAVLLALILLTLYSIYLVWALLASP

SEQ ID NO: 31222 - protein, 211 aa, Pseudomonas aeruginosa
RVALQVADRLPAEGADGYHDHHRHQGRHGNPPDPVAEEHHHQQQRDAGHQGREPAAPAGFNIDHRLADHRAASHAAEQAGGDVRQALALAFAVLVAAGVGHLVDDGGGHQRLQKADHRQGGGVGQDDQQGVEVQRHVRPEEQRQAVGQLTHVADGADVQAQVDGYAGEDQDAYQRRGQQPADPGQVREAVDDRQARGGHRVDRPADIGEFG

SEQ ID NO: 31223 - protein, 133 aa, Pseudomonas aeruginosa
LGHEDEDRQGIDETGHHRARDEAHQRTQAQVAGEYLQHAAEQGRRQQVLQAVVLHQVDHQQRHGASRGGDHSRTAAGEGDHHRHAEGGVQADLRVDPGDDGEGDGLGDQRQGDDQAGEQVAAEVGEPVLFQRL

SEQ ID NO: 31224 - protein, 257 aa, Pseudomonas aeruginosa
RHNAIRHDPPLERRIIALRLSALPHGSRFLTPGQARRRCRASPSCAERPWRSRLAASVCSTCSWLLEAIEAISVRLREMSSATAVCSSAAVAIWRFMSRIDSTEAVIWRSMAPALATCSAPASLRDCPLSMARAAFTAPFCTVSMIWWISAMDSAVRCARVRTSSATTAKPRPASPARAASMAALRASRLVCSAMPRITSRTLPILPLSLSNWRMTSTVWSISLRISPMLRIVSSITSSPRWAESSASSAALAASPA

SEQ ID NO: 31225 - protein, 601 aa, Pseudomonas aeruginosa
TCSSTSPTPLAGVRRSALAAQDDGSATFPEQPQQGKAMNQPSYTSGRQDVALLATTVGDAFDATVARHAEREALVVRHQRLRYSWRQLAERVDAYARAFIALGLRPGERLGIWAPNCAEWCITQFASAKVGAVLVNINPAYRSSELEYALKQSGCSWLICADAFKTSDYHAMLGDLLPELARARPGELASERLPELRGVISLAERAPAGFLHWQGLPGLAAAVGAEELRQRQASLQFDEPINIQYTSGTTGFPKGATLSHYNILNNGYMVGESLGLGAEDRLVIPVPLYHCFGMVMGNLGCVTHGSTMIYPAPSFDAEATLLAVAEERATALYGVPTMFIAELDHPRRREFDLSSLRTGIMAGATCPIEVMRRVIGDMHMAEVQIAYGMTETSPVSLQTGPDDGLELRVTTVGRTQPRLESKIVDQTGRVVPRGEIGELCTRGYSVMLGYWNDPQATAEAIDPARWMHTGDLAVMDDDGYVRIVGRSKDMIIRGGENIYPRELEEFFFTHPAVADVQVIGIPDERYGEEIVAWIKLHPGHHADDEQLRAFCKARIAHFKIPRHFKFVDEFPMTVTGKIQKFRMREISIEEIRLLALRQGRD

SEQ ID NO: 31226 - protein, 148 aa, Pseudomonas aeruginosa
KRSPDVSPISSRPRAYARATASPACCRARPSCWSPSSAPGAWARCTSRCSPPSARRPSNTGVATAGSKVLVTDAANRDKLDELADPPLAVTVGGPKGQGIRRGDFSFWAELECYPAEFEPVPRSGEDPFLMMFTSGTTGLAKPVPVPL

SEQ ID NO: 31227 - protein, 493 aa, Pseudomonas aeruginosa
  UNSURE (21): Identity of amino acid at the above locations are unknown.
EIPAFVGDMREAVDLRPKDAXLEPRQSGLALRAPNYAVAGPFAMGHRTTFYEGPFSVESTCRIIRGLRHHQPCRIAHRLSPADGRRRGRGNCAEGAHARGQQRRRAVDPGGDPLVRRQARHHHPRSLRADRAGHGAVQPPCPGASGAGRRRRIRLSRAPGSSAGRRSQRTAARPARHPRPRPAAFAADVVSRLPGPGNRSLRRRLLPERRYRRTQRRRQHQLRRPRRRRHYHLWLPGRPVRCGERADRTPGSDGGGGDRQARPGAHRTGQGLRRALRRPPADAGTGGRIAAIRAPAPVGARLPAGDRVPRGTAEDSQRQDPALSPAQPGDRPATRGGPTGGRRELIQQEKTTCVSKIECSWLPAAAPASAPPPRRCWWSRVARWCWPTSTPRPARPMPPSLAPRRASSGPTSPARPTAARPWPLHWRPSAASMAWPIARAWRRPRRSSDAMASMPWRVSAGSSTSTWWAVSTCCAWPPRPCPRASRTRAASAG

SEQ ID NO: 31228 - protein, 188 aa, Pseudomonas aeruginosa
RRAAAEGPAGQDPDPEAGVPRRRHGDRGQLQFDFRRRRRAGPDAPFRGRATRARAVGGDSWACFVRRRAEPVPHRAGRCGEAPDAAYRLVAGRGRPVRGQRSLRRGRHGGNARPRPVPRAPQRPRRRLCAGPSDRRVRRADRRDPAQRPAAVRPGTRRGGGLHRRRRGDRDRRRALALMQAVKKRNPR

SEQ ID NO: 31229 - protein, 146 aa, Pseudomonas aeruginosa
SSSRSPIRMPESAASARSSCPPTRPATRWCGSRTSSASTPRTPASWPSTTCVSRPRCAWARRARATASPWPTSKAAASASPPRRSAWRARRSRRRATTPMSGKPSASRSSSTRRWPSAWPTWPPASPWRGRWSTTPPACAKPACRA

SEQ ID NO: 31230 - protein, 127 aa, Pseudomonas aeruginosa
SARASSGWPGPDRCSRASTGGFPASARRSPAAPRSAGRGDGRSVPARSSPCRSAGPPWRPSGSAASAARSCAGCPSCPAPGRCSRGRCGGWKYGCGSGPGNRPGPASACPPVGGRGAWRRRSGPPSA

SEQ ID NO: 31231 - protein, 433 aa, Pseudomonas aeruginosa
ALFRHRYQRLCPMPRLPTRQKVSPMDFAYSPKVQELRERVSAFMEAHVYPAEAVFERQVAEGDRWQPTAIMEELKAKAKAEGLWNLFLPESEYGAGLANHEYAPLAEIMGRSLIGPEPFNCAAPDTGNMEVLVRYGSEEQKRTWLEPLLSGEIRSAFAMTEPGVASSDATNMEARAERQGDDWVINGRKWWTSGACDPRCKILIFMGLTNPDAPRHQQHSMILVPVDTPGVKILRPLPVFGYDDAPHGHAEVLFENVRVPYENVILGEGRGFEIAQGRLGPGRIHHCMRSIGMAERALELMCKRAVSRTAFGKPLARLGGNIDHIADSRMEINMARLLTLQAAYMMDTVGNKIAQSEIAQIKVVAPNVALKVIDRAIQMHGGAGVSNDFPLAYWYAMQRTLRLADGPDEVHRAAIGKFELGKYVPREMLRSSR

SEQ ID NO: 31232 - protein, 260 aa, Pseudomonas aeruginosa
CPPGTRWLCGLAPCRPCGLPRTGMARPSARPIAVAKRACRRSFGRQGMRSMPDQVTDVRLLDDGYSREVRSLFYHAYRHEPTFAYLMDAQRAGYDQRVRACVREMVERHLGEELPAIGLFIDDRLVAAALITPPQRRLDITESWSWRLRMLFSVGLAATRRYLDYHRAVQACLPVGPHHQLPMLGVHPEYQGRQIGEQLLAAVQRWCAEDSASQGLVLDTGNARYLDFYQRHGYREIGEVTLGAVREHVLLHPGETPAAT

SEQ ID NO: 31233 - protein, 171 aa, Pseudomonas aeruginosa
PRRAGRGGVATFPSQCRGAGGKGGPGARLLPGADRQRGEGRQAAEAHAQGSARRARAPAPGEHPGARRGRQPGELPLAVGQATESGREAEPGCLRGRQAADPEPGLALRLLPGPLQHPAPEHRSARRHRRHRPGLRQRPALHLRQGELRRRLDHRGRTVAPHGAVQGRPTL

SEQ ID NO: 31234 - protein, 1498 aa, Pseudomonas aeruginosa
PGIRVGNLRTTAERRRLVRDSPRSAAHRQAALHQRLPVRRPSRHREQAADPWRRMAQQAARWLAAGGFAELDARGVQAGRRLRAEQLPDAGDRLLAAGDRQQGRPQPWLPPAVQRQGGEGRPAGRRRRPPCRRHGQGPDQLRRRPSPARPPAGRRNRHQRLQVDPALAALLRWRRPERAWLRLPDAVAGEFRWRQDRRPLHDRRQRRVSISAGRALAPGDLRRPGQRLQLAGLPVDQDRGRLRRALGLAGRPVAPRPGPCARRRRRFPPALLHGARTVKALKITLLAIVGLLLALLLGLAALLGTQAGSAWLLGRVPGLQVSGFEGRLGGAWQARRLSWAQDGTQLVVERPELRWSPACLAGLRLCLQRVAAERVALDLPPSGDSADSGPISLPTLKLPLSIELGEVAVGSFLLDGNQQVAELKLAAHWLADGLHIDSLTARGFGLDLALQGRLQPSGDWPLQAEATLGLPAPEGKPWKLAVQVGGELQQALTLKGRSSGYLDGSLEGQLQALAENLPARLLIRADGFKGTAGLPDTLTLNAIQLDAGGDLKSGYLIRGGASLPGEGGAVALSLDGRVDAQGADIRQLRLDAGGEQRLELVGRLDWRESLAADATLDWKDFPWLRLYPLAEPPPVTLKTFKAEVHYQDQRYLGNFSAAASGPAGDFTLASPVSGDLVQLNLPSLQLRAGQGQAEGRVTLRFDNGVAWDTALQLSELNPAYWVAELPGSLAGPLRSQGSVRDERLALGVDLDVKGRLRGQPALFQARAEGEGQRWTLGNLDLRLGDNKVHGSGALDQRLQGRLDIALNRLGQLWPQLFGRLEGRLDLAGSLAAPQGRLNLKGQQIAYAEQRIAGLDLQANLDARQNGTLALVASGLRSGETDLGLFKANARGDQRRQQLELDLQGALLKLGLAFDGQLERGNWRGRLARGELSSGGQDWKLQQPARLERLADGKVNFGAHCWVSGGASLCGGEQRLLPEPRLRYTLRDFPLDSLKQWFPEDFAWQGKLNGDLQLDVPARGPSGVVSLDAGSGTLRLRDQGQWVDVGYDSLRLESRLAPNRVDTSLDFRGPKLGELRVQAQIDPRPASKPLSGEFSLAGLDLSVARPFVPMVEKLQGRLNGSGRLSGGLLAPRVDGRVTLSDGNIGGGELPTSFENLSLDARIAGESLELGGGWRSGRYGQGSLSGNLSWGDALNVALNIRGNRLPVVVDPYAQLEVEPDLKIGMAGQELAISGKVLVPRGDITIRQLPPSTVKVSDDAVIVGSEQPEQQPLKMKMDIDVEVGQDKLAFSGFGLSAELAGHLHIGDNLDTRGELNLNKGRYRAYGQRLTIRRARLFFAGPIDQPYLDIEAIRRVDDVVAGLRLTGSAEQPTSAVFSEPAMSQEQALSYLVLGRPMSTGEDSNMLGEAALALGLAGSAPLTGEIAKQLGIQDFQLDTEGTGNSTSVVASGNITDKLSLRYGVGVFEPANTIALRYQLTKRLYLEAASGLASSLDLFFKRDF

SEQ ID NO: 31235 - protein, 85 aa, Pseudomonas aeruginosa
SANMPARWAPWSALRRRYDGPMGKSDRALCFGVIGAGVASGLLPLAWIDWLMLLIAALLLLTIGNRVRQGLAELSASRRGSNGQA

SEQ ID NO: 31236 - protein, 139 aa, Pseudomonas aeruginosa
SSSTATGRPAARRRTARARRCCCSTAAMSTPGGSPIWSTNSTCRNTTSSPGTPVATASRQAPAATARALLPACATYRPSSTISRPSTVSPKSGWRWWRRASARCWFPPGPTTTRRRCAHWCWLRRRSRSSSTCRSPAAG

SEQ ID NO: 31237 - protein, 144 aa, Pseudomonas aeruginosa
FPGPTSSSIVRRRSASSSVSAACARKSTSCPASSTTPLASAIVTWPSAVPGASSSRHSPRPPNDRACSMPTAWAIPAPRPRRWPRRCRRTRRAISTGAPPVPACAWAACGRMGSSWASTPASIPAAPSTMSTATSPAAAAHWVA

SEQ ID NO: 31238 - protein, 514 aa, Pseudomonas aeruginosa
CGAGPRRKWTSWWPPPASARSPSGSTSGASSAYRWRRRSPADGAARAGGTEAGGALAAVPRPVLLRQLWPGQLVDQPARRRRQPGLRLGTRDAAVALDHPAVLVDRPALRPVAVVAAGQARAGHPLPAPAQRPGAVGDLLPAVPPALHLRTAGTGRRVRLAVRRADGVRQTVQPGTVAAHRPAGSALGLLRALRQRRLALAAAWLVRADRAVGADHLAAPFHRRAHRRAGRLAVRLAVAAGAARAVRPRQSEPRPATAAAGRSLRPRRAGLRRRRLCRRRCGVVAVLAGAGAGAGGAELPAVRRRRLPEGQHWPPERRRALAAGAISACRADQRLALDPSPAAAGRGAAGPLVGAPAVVRGTGRQPLPRIARRYRRTFLRAAGAGLSQPAVARPGRAGRRGLPARRGADRRTAGARAAAGGLCPGLFAQRHAGRRLAAAQRPRGGRRVGRGGVTSGATASAAGRGPAADPRGAERERAGAIGGTGRGAPCLSKPWPWWRPCCAVAASLTGCPPH

SEQ ID NO: 31239 - protein, 194 aa, Pseudomonas aeruginosa
SVLASSPAPNASAAGHRAGGFSLTRRINAMAQVTLKGNPVNVDGQLPQKGAQAPAFSLVGGDLADVTLENFAGKRKVLNIFPSVDTPTCATSVRKFNVEAGKLANTVVLCISADLPFAQKRFCGAEGLENVVNLSTLRGREFLENYGVAIASGPLAGLAARAVVVLDEQNKVLHSELVGEIADEPNYAAALAAL

SEQ ID NO: 31240 - protein, 502 aa, Pseudomonas aeruginosa
WRQNIGGRSSDCARGAPGRRTAGERRAGSEREGEAPGQRARQVHRVGLAFAVGIAGQAQFALVAEVFQVGAEEAVQAVVEAHGADRRPDLAVLHPEGGEAGHSGQACGGHVRVVQVPQVADVQAGIQGLEDARLLQAAAGHVQRRGRLVGAGAIGYQAIFAGAARTHQASAQAAVADQFDLGARRAFRAECRGGRGGRALGEVQQRAEQGVAVLQALQGAFAGSQGARGETAPAEHLHDFFERRRRQVGAVVAGAQLAQRLAQVAELLPGLFEAPGEGFVVPALAGVVGLHRLAVAVEQAPVEVEAAAGMPAEGAPGVGEATEQRSGGIDADQVEVARLAFEAGQQRPAVGRCAEVLVLSLPGRGVEQQIGIGGNPGQALAQLPKAFGQTLAVFFRRAGERQVEARLAFVADQPEQRAGLAHPTGLAHPRPVEADELGVLGAVPEGEVLALGQVSAQVLGEGFEMLSLVHQASPPNTSTSLNTQAGEAWPTRITWFGSPLPQ

SEQ ID NO: 31241 - protein, 429 aa, Pseudomonas aeruginosa
RRTMTPTTGKSKFRTLRPWLITALAFAAVIGLVMWLAAPASAPSSDGRPGRGGKPGAALPKANALTVGVARVEQGDLALHFNALGTVTAFNTVNVKPRVNGELVKVLFQEGQEVKAGDLLAVVDPRTYKAALAQAEGTLMQNQAQLKNAEIDLQRYKGLYAEDSIAKQTLDTQEAQVRQLQGTIRTNQGQVDDARLNLTFTEVRAPISGRLGLRQVDIGNLVTSGDTTPLVVITQVKPISVVFSLPQQQIGTVVEQMNGPGKLAVTALDRNQDKVLAEGTLTTLDNQIDTTTGTVKLKARFENADGKLFPNQFVNVRLLAHTLKGVLTIPANAVQRGTNGIYVYVVGADNKVSQRSVAIGTSENERVVVESGLKAGEQVVVEGTDRLRDGMEVRVAEASPQVLEGEPQKPQTGRPSGLQGDSVGSGSAE

SEQ ID NO: 31242 - protein, 916 aa, Pseudomonas aeruginosa
TPRPGSTGTPGDESVHALHPPPGRHHAADPGVAAGRHPVVRPAAGGAAAQRRFSGHRGQRQPAGRQPGNHGLVGGHAAGALAGTDRRDQRDDLQQFAGLDHRGARVRPGEGHRRRRPRGAGGDQRRDEPAAQRYAEQSQLPQGQPLGHADHGPHPDLGDPESRRDVRPRLDRAGAQAVAGAGGRAGEHRRQLAAGGAGRPQPGCHEPVRAVPGQRAHGHRRGQQQRPQGRRREGRQALAGGRQRPVAQGPRVRAAGDPLQRRQRRRGAPRRRGQGQRLGGGRAQRRLFRRSAGGAADRHPPARRQHHRGHRRHPRATAGVAGTARAAGQAERDGRSQPVDPCVAGRGRADPADLGGAGDPGGLPVPAQRPRHADPQPGGAGLADRHLRGHVPVRLQPEQPVADGADHRHRLRGGRRHRGGGEHRPTHRGGRSADPGGDHRCPPGRFHRAVDDALAGRGVHPAAAHGRPHRAVVPRVRGDSLGGDPGVPGGILDPHADALRAYTASAETARRRFPGAAQRSLLRRLHAALPRQPGLGAGALAADGGDHAGLHRHEPLVVRGGAQGLPPAAGLRAPARLRGGRPEHLVPVPEREDGRVPQDPLFRSGGGKRGRLHRRRPLAVEQHRFVLRHPQADRRTRPGGEGPHPAARADRQGARRGALSQRRPGRAPGRPRQQRAVRIHPAQRRPDPAPRMGAEGRGGDAQAAAAGGRQQRLPGQGRADPPGDRPRPRGDPGDQRGNGRRGAQRLLRPAPGVDHLQPAEPVSGGDGGRPAVPAEPGDPPPGPGDRQRRPARAAVRVQPLRTEPGTAGGQPPGPVRRHHAVLQPGAGRADRPDPRGHHAGPGAAAHPGGRADQLRGQRRRGAGHAEPDALADPPGAAGGVHRPRHPLRELRAPADHPLDPAFGRGRRAARADPLPQ

SEQ ID NO: 31243 - protein, 629 aa, Pseudomonas aeruginosa
AEPDRADRHHPADRHRQEERDHDDRLRPGGRAQPRPEPARGDPRGLHDALPADHDDHPGRLARRLAADLRHRRRRRAAPAAGHHHRRRADRQPVADPVHHPGGLPLSRPPAPLGQPETRRTHGRCAGDTPMKHTPSLLALALVAALGGCAIGPDYQRPDLAVPAEFKEAEGWRRAEPRDVFQRGAWWELYGDQTLNDLQMHLERSNQTLAQSVAQFRQAEALVRGARAAFFPSITGNVGKTRSGQGGGDSTVRLPDGSTVSSGGGSGAISNSYSTSLGVSWEVDLWGKLRRQLEANQASLHASAADLAAVRLSQQSQLAQNYLQLRVMDEQIRLLNDTVTAYERSLKVAENKYRAGIVTRADVAQARTQLKSTQAQAIDLKYQRAQLEHAIAVLVGLPPAQFNLPPVASVPKLPDLPAVVPSQLLERRPDIASAERKVISANAQIGVAKAAYFPDLTLSAAGGYRSGSLSNWISTPNRFWSIGPQFAMTLFDGGLIGSQVDQAEATYDQTVATYRQTVLDGFREVEDYLVQLSVLDEESGVQREALESAREALRLAENQYKAGTVDYTDVVTNQATALSNERTVLTLLGSRLTASVQLIAAMGGGWDSADIERTDERLGRVEEGLPPSP

SEQ ID NO: 31244 - protein, 522 aa, Pseudomonas aeruginosa
TAAPARPAADALDPAGARPGAVPRRFLRRVPAVAAPRRLLKPASGSARRREQQAQVGLLLRYAFRFGAAAVVGHDRLHDGQSQAGAGLGSSLASGAAVEALEQVRQVLRRDARTVVADPHLGVPRAFPDPHVDAPALRGVAHGVGHQVGNGALDHQVVAVGEAVAGQAQFDALVLGDHLVQVDDLGRLLVQGDAAELGLDRRVVHLHQEQHVGDDPRQPLQFLGIGLQGFAVCRAVAMLAEQHLVAHQQVADRRAQFVGQVVGELRELAYAILEAAEHVVEAAGQAVQLARQVLLGDAVGEILRADLGGHPAEAVQRFEAGTHHPPGGQGDQWQEEGQGQQGGAEETVEQALVGVALAAQQHLYRGAVLHAHGSADAQQALVVAGAPALEHRLAGIRLQAGEKRAVGRDAGRGLVAEAHQRLAAAAVENAQVQAAVSHQLVLQGMRLYGRVAAQVEIVFQAVADLLQLQLQVFPLAGFQLAAEVPVRHCAERQGQQRAEGADQQGQAQRQSAWWRHRRASRT

SEQ ID NO: 31245 - protein, 172 aa, Pseudomonas aeruginosa
PTPRMVWISLRSKPSSIFARRRQMATSTTLESLSKFMSQISEMICVRVMTSPLRRISRCSRANSLVVRLIRTRPRKARWRLASSSRSATRRTSCIGAWSWRRSSERTRASSSGNWNGLTMKSSAPRSRPRTLSVSLPCPVSIITRALLRSRRRRSRSQPSMPGRLTSRITSS

SEQ ID NO: 31246 - protein, 478 aa, Pseudomonas aeruginosa
TVAWFRAGNGSPSPTTISRRGAEHADTSATGQRGETRLLATDGTLPGPAGPGERSAGEFQRHFDQPRAGVGAGPAEQPRAGGGGARDRDRQRRAAAGRADPQPGSVLERRGHPPGQSPDQRQHRPAAGAGRQARCAGGGGETRQRDRLDPTGSPSRRTARPGPRRLLRGADRAGAGAPGEDLPGPGQARAAGRRPTGQGRQHLLGGTGSRPGPGGQRPARPEPGGAGAAAHLCAAVEHLGRAAARLRQGRRRARRGAGEHHPWRLAAPSRRVADPAPGGPGGRARRGPGRPGEAPAHPQPDGQHRQQVRPDRPRRTWRTGQPDRPVDAAAAVRPQPGQHLRRPEPRRPGPRPAARDPAAPAQRSGTGLRPVAHLGTGAGAGPSRPAARRTERAGLDDPRLRDGQVQLPRRARCPAHPGRRPCPVRARAGRRGTGAGEHGAPARRRHRPPRPVRFPGRAAGAPPERFGRTEWARRRLSR

SEQ ID NO: 31247 - protein, 1131 aa, Pseudomonas aeruginosa
RSPTARCRTSTARTWCSSAWPMASWSSRSSWASATASASRSSRACAPAARSPPAAASSSNPNWARARRNTVTESRSRSLRMFERIIQFAIEQRWLVLLAVLGMAGVGIGSYQKLSIDAVPDITNVQVQINTAAPGYSPLEVEQRITYPVETVMAGLPGLQETRSLSRPGISQVTVIFEEGTDIYFARQQVNERLSTAREQLPEDISPTLGPISTGLGEIYLWTVEAEEGATKEDGSAYTPTDLRTIQDWIIRPQLRNVKGVAEINTIGGYAKQFLIAPDPKKLAAYKLTLGDLQNAVLRNNENVGAGYIERRGEQLLIRAPGQVKDMDDIRGIIVSNVDGVPIRIRDVAEVGLGKELRTGAATENGREVVLGTVFMLIGENSREVAQAVGQRLEEINRTLPKGVKAITVYDRTTLVDKAVATVKKNLVEGAALVIAVLFLFLGNIRAALITATIIPLSMLFTFTGMVGNRVSANLMSLGALDFGIIVDGAVVIVENAIRRLAHAQAHHGRQLTRAERFHEVFAASREARRALVFGQIIIMVVYLPIFALTGVEGKMFHPMAFTVVTALLGAMILSVTFVPAAIALFITGKVKEEENFVMRRARLAYEPALRWVLGHRALVVGGALGAILLTGLVASRMGSEFIPSLSEGDFAMQGLRVPGTSLTQSVEMQQTLERKLMGKFPEIERVFARTGTAEIASDLMPPNASDSYVMLKPQSQWPDPKKSREALLEELQAAALEVPGSVYEFSQPIQLRFNELISGVRSDVAVKVFGDDMQVLNDTAEKISKVLQGIDGASEVKVEQTTGLPVLTVDIDRDKAARFGLNVGDIQDTVATALGGRNAGTLFEGDRRFDIVIRLPETLRADLPALSNLLIPLPPNNLARIDFIPLSDVARLDLSPGPNQISRENGKRRIVVSANVRGRDIGSFVLEAQQKLQDGVKIPAGYWTTWGGQFEQLQSAAKRLQVVVPVALLLVFTLLFAMFNNVKDGLLVFTGIPFALTGGVLALWLRGIPLSISAAVGFIALSGVAVLNGLVMISFIRNLLQEGRSLDQAVWEGAITRLRPVLMTALVASLGFVPMALATGTGAEVQRPLATVVIGGILSSTMLTLLVLPVLYRWTHGRDAGPREETPAAG

SEQ ID NO: 31248 - protein, 612 aa, Pseudomonas aeruginosa
RLLAFSARGRPRARRLPLQAGDVHRSTPVRTGDEAHLRGQLGLSRPRKPGCRSQRLPDHPDRPPVDRHRAQPRRPAQRLHQRLQPPWRDALPAQERQSQQLYLSVPRLDLQQLRQAAQGQGPGRGRLPAGLQLRGLARPDPGGALRVLPWLPVRQPQPRCQAAGRAPGRVGEDHRHDRRPVAGRPRGAARLFQLCLRRQLEAHRRERRRRLPRQLGALELRGDPEPAPAARRRGPAADHERRGLGPAGRRLLLVRAWPHAALESLGQPRGPAGLRAPRRACPRLRRGPRRLDDRELAQPLPVPQRVPDGPVQLADPHRPAAVGGPHGNHHLLHRAERRERRGARPAHPPVRGLLQRQRHGHPGRPGGVPFLPAGLPGQRGRLERPVARRRTLDRGRRRGGRGHRPAAAPERRAHRGRRAVRIAASLLAGGAARRPGARTDAARGAAGGGVMSLGYDALRDFLYREARYLDDKDWDAWLALYAADASFWMPSWDDRDQLTEDPQREISLIWYGNRGGLEDRVFRIRTERSSATLPDTRTSHNLSNIELLGEDDGICRARCNWHTLSYRYKTVDSYFGTTFYDLDVRGESPLIKAKKVILKNDYVRQLIDVYHV

SEQ ID NO: 31249 - protein, 348 aa, Pseudomonas aeruginosa
RPRRRAVEGHAMNHRIALNFEDGVTRFIHAAPGETVADAAYRQGINIPLDCRDGACGTCKCLAEAGRYALGQDYIDDALSAEEAARGYVLTCQMRAESDCVLRVPASSTLCRTGQARYEARISEVRQLSPSTIGLSLRGEALASLAFLPGQYVNLQVPGSEQRRAYSFSSLAKDGEVSFLIRNVPGGLMSGFLSGTARAGDSLAMDGPLGSFYLREIHRPLLMLAGGTGLAPFTAMLERIAEQGSAHPLHLVYGVTHDVDLVGLERLEAFAERIPGFTWSACVASADSDYPRKGYVTEHIAAQHLHEGDVDIYLCGPPPMVEAVERYLREQGVRPANFYYEKFAASAA

SEQ ID NO: 31250 - protein, 483 aa, Pseudomonas aeruginosa
PRRPSQSASASAEHRDEAEAGKPLGVAGDPLQFAEIGGAAYPVVEMHRPIAAALGQFVEHAEERRQAGAAGHQQQRALHLTQVEGAQRRLEADLVADPATLAQVVAHGAAREQADEELQVVLRIRPVGEGVGAPAVAAGYLQARVLAGQEVQLAARGAGVEAEQRGVLGEQAQFAHHAAVRLGRGGVAEGRGEVEVEGRVGAHPGLAGEHLALLQVGGGEGVLVGVVQAVAARLAAAHAGAADPFAAVQRQVDAVAQGGVEEQVVVADGQEQGLAVGEAEGDFVIHRDGARRSEVVEVEDRVDPVVEQDDVLARDQPGLAMGFQAVGGMAEEAAGLVQALEQGLPVDPHSQQAFAFLGDAHVADLVQGARHRHGGRGLAGADTEHPVFQAGTAGVVDQRHLALRIAGVALLGLPLRQVELALFVELREVAVPVLGIAEFGVAVEELFDAVLQSGVHGVTSFARRARRSRPSRRKRRQCACWLT

SEQ ID NO: 31251 - protein, 351 aa, Pseudomonas aeruginosa
KQSASRAHPQPCRVECRTMMRTHPVADRGDLHADHLDLAAARSWMSKVCGPHRLEAASPGLVQFEHHGNVLKSMCTTLGYIGYGTDVTITVEDAAAFNAYSLSLPLSGEQELCRGGLRLLSDVRRGVIIAPNERQELSIAGDCRKLQVVIGRTAMRKVLEEMLQRPIDTPLRFDPEMDALDGASASWWRTVRHISEEMARSELYAQAFFSSDLERALIKGLILAQPNNYSEALQQGLGGRPPHYLLRAREFLQANARETLSLEDVERAAGVSRFKLFEGFRRYFGVSPMSYLKHYRLAAVREEILASGGARSISTIALGWGFSHLGRFSVDYRKRFEETPSMTQRRAARRS

SEQ ID NO: 31252 - protein, 389 aa, Pseudomonas aeruginosa
AANRRKPDRNPGGPPRMSQAVIQSLESIIVDLPTIRPHKLAMHTMNRQTLVILRLRCSDGIEGLGEATTIGGLAYGSESPESIKSNLDAHFAPLLLGQPADNVNAAMQRLDRHIRGNTFARSAVETALLDAHGKRLGLAVSELLGGRLHDSLEVAWTLASGDTGRDIEEAERMLDLRRHRHFKLKIGAGEVDADVAHAIAIKRALGERASVRVDVNQAWDEGVAQRACATLGDNGIALIEQPIARHNRVGLARLSSRGGAPIMADEAIESVEDAFHLAREGAAPVFALKIAKNGGPRAVLRSAAIAEAAGIGLYGGTMLEGGIGTLAAAHAFVTLDRLAWHSELFGPLLLTEDILLESPRYQDFHLHVPRAPGLGLALDEERLARFRRR

SEQ ID NO: 31253 - protein, 432 aa, Pseudomonas aeruginosa
SRPADRGETTDAVPREDDREVARRHGPATGRAAQGRGEGNGPAPPARGQLAAPLADRRALRQLQPVRPAQRRGAARHPDPAAAVSLHGHRDRRALPASLVDPCRRPLRFPSHARQQQAEANAMTVKISQTADVQRFFEEASGQLNERGDPRTKALVRRVLDDTAKLIEEMQVTPDEFWKAVDYLNRLGSRQEAGLLAAGLGLEHYLDLLLDAQDAEAGLTGGTPRTIEGPLYVAGAPLSDGEARMDDGRDAGTVMFLQGRVSGPDGQPLAGAIVDVWHANTQGTYSYFDSSQSEYNLRRRIRTDADGRYRARSIVPSGYGCPSDGPTQELLDRLGRHGQRPAHIHFFVSAPGHRHLTTQINLAGDRYLWDDFAYATRDGLIGDLRFNDDPAAARDRGVEGGRFAELDFDFQLQSSPAPAAERRSQRPRALQE

SEQ ID NO: 31254 - protein, 539 aa, Pseudomonas aeruginosa
VENYVSDNFGDAPLHGGGVCAKRIKCELRLRKSNPRLMSASFPRFQNQPHGQCRLRQDCAGARSTRSSRTASAARHGRRRKTDMNRSGAIAMQGDGKKRLWTLPLLLGAGLMASAVAEENAERSKEGFIEGSEVNLLLRNFYFNRDFRKGQSSPAGGGYTEEWVQGFMANFSSGFTQGTLGVGIDAFAQLGVRLDSGGGRSGAGGSVDLLPYDDQGRPQDNYSRAGGAVKLRWYGTVLRVGDVFPETPVIQYGNSRLFPSSFRGFTLVNDSLAKGLTLQAGKLNSMTQPNSTSGSDDFYSFYTGRRIDSPWVAYAGGDYQATEHWSVSLYGSRQKDAWDQYYAGTSFNYPLDDKLSLLGGANYYKVKDQGRQVMGELDNDIWSVRGGFAYGPHQVLLSYQRNNGDDDFDYLRQTDSIYLDNSIQYSDFNSPKERSLMLRYDLDMAAFGVPGLSFMTRYGKGWDADYSNANSVYMRTDANGNPLTNQGRWERDVEVKYVVQGGAAKDLAFRVRQATVRSDSFESDLDEVRLIVEYPLQVL

SEQ ID NO: 31255 - protein, 151 aa, Pseudomonas aeruginosa
SSGLRLLPIFPDLTRLASLRSRSARLARARRRALALAGDSSSSGRAMIRAASASPYCRARSTVFGSEIAPSRNRRSARTASRCAAPICRLSWCTATPWSSSHLAASRRPRARQASSTPPRPRKVSAKSQPASRRRCSRSMSPSCAASARAS

SEQ ID NO: 31256 - protein, 84 aa, Pseudomonas aeruginosa
PQADKYQRSSSGLGARLTSMSGTRPTRVNMDSYGVTFAIIVLGMLFIGTGFTKRDTPFGLFLMWVGVICMLAIISYRIYIATHY

SEQ ID NO: 31257 - protein, 141 aa, Pseudomonas aeruginosa
RLVLFRSAPWSRVRRRISRRPSAPASRYGLSSRLFCRLTSAPASINWRATARWSLAVASSSGVLPSALGASTSTLRSSRLATCAVSPRRAASSNAPASLAPAPPLNAAQTSMAPLLHRLARDMSMGSDRRWRKVWRRCHVC

SEQ ID NO: 31258 - protein, 490 aa, Pseudomonas aeruginosa
CLSVGVCMLDLVLLRTFVSVVDTGNFTRAGEHLHLTQSTVSQQVIRLEQNLGCRLLDRSQRQVLPTEEGERLLGYARRLLRLSDEASEALSPAHGDGVLRLGVPEDLAGEVLMPVLTRFTEERPRLRLEVESGLSHHLLRLYRSGELDLLLVKQWGADSDCHARWAEPLGWFGSAARPFGEGSPEEPVPLVVFPVGALYRQEMIHALESIGRRWRIGYSSASLASLVAAVGAGLGVSLLPLGCVGPEHLLLGAQAGFPPIAGLELALYARPELDSAGRTSATACATSAMRAWKGCRASVERCLRAMIRLPQRMDTEARHMSRPTLQVDLLVESFNYKAWSDRRTLDAIARIDAEAFPASLAFALQQLNHMAIVEELFRARLLGEPAPHQQTNSEVVPGYDVLRRRLEDSAAWFAGYVAELPLERRGEWLRFRFADGRDGGMTRQEILFHIVNHGTYHRGAIGHALDLAGAPRPADTYTLYIHSAQPERRE

SEQ ID NO: 31259 - protein, 1047 aa, Pseudomonas aeruginosa
TDPGRTRARSGSTARESCMHLWQAFVVGGAARFAVLHEAADEDVEHRRQQQAEEGHPDHPGEHRHAHRMAHLGAGAGGDHQRHHAHDEGDGRHQDRPQAQAAGFQHRGDAVHAFLLLVLGELDDQDRVLARQPHQNDQADLGKDVVVAAGQDHPGDRRQQGHRHDQDHRQRQAPALVLGGQHEEGQQHAEREDEQRGIAGEDLLVGQLGPLVGHAVGQFLLQQLLDRRLRLAGAVARGRGAVEFGGDEAVVVHHTVRTGGVADLDEGRQRDHLAEVVAHLQLADLLGFEAELLLGLDVDLIGTAEAVEVVRVQRAEVDLQGVEDVADRHAVGLGLLAVDVGVDLRHVDLVAGEHRAGFQLRQRTGLGDDVLGLLEQLLVALVATVLDLQAEAADGPQPLYRRRREDRDVGVLDVGVLGVQRGGDGPGRLARVLALVERLQRGEHDAAVRAVGEAVDRQAGEGHRVRHAGLRQGDLGHLLDHRLGTVQAGRVGQLGEGHQVLLVLLRDETGRRAGEAEVGQHHQSAVDQQGDRAAAQDPVHRADVAMAGAVEETVERTEQPTAEELVEEHREAVLRLVVALEQDRRQRWRQGQRVERRDHRGDRDGQGELAVELPGEAGDERGRDEHRAEHQRRGDDRPGHLAHGTLGGFHRLEAEADVALDVLHHHDGVVHHDADGQHQAEQRQRVEREAEHVHHREGADQRHRHRGQRDDRGAPGLQEQDHHQHHQHQGFEQGVHHRLDGAADEDGRVVDDGVVHALREAVLQLGHLLPHQVGDLDGVRAGTLEDRDRHRRLVVQQRAQGVLVGAQLDPGDVAQTGDLAVGAGADDDVLELFLGDQATLGVDRQLEAGIARRRRRAQGAGGDLAVLLADGVDHVGGGEVARGDLVRVQPDAQRIVAEAEQLDVADAVEAGQFVLHVEHRVVRQVEHVVAVIRRGQVHDHGQVGRGLVDGDAEPGHFFRELRLGPGDAVLHLHLGVVQVGAEGEGDGQGQLAVGGRLGGHVEHVLHPGDRLFKGRGDGLADDFRVGAGEVGADHDGRRHHFRVFADG

SEQ ID NO: 31260 - protein, 449 aa, Pseudomonas aeruginosa
LEQGDGAANQDQQRQHRGEDRPLDEELGEIHRFFLSPRSAARLVASGVVLGRRHLRWFAVADRLPQAREGGQGVGAGHLDLLRIHLHARADPLQAIHDDPVALAQAAADDAQALQLRSHLDGAVDGLVVAIQDQHELLAQVGADRFVLDQGGGVGLAADQLQAHVEARGELALGVVEHGAAADGAGTRVDLVVEEVQPAQVRVAVLAAQAEVDRALAARVATGLAGQLDVLEEHAFVGVEVGVDLVGADQGGEQGFPGVDQVAGGDLGAADATVDRRGDPGEAQVQARRVQLRLGRGDRRLGFLGGGGAGVGEFRGDRVAGAQAFAALGFVDAPRLGRAGLLHLGFEALDLGLERARVDLEQQVAFLHQCAFMEGHAVDVARHPRAQLHRLRGLQAAGEFVPLVQRLFDDFGDADLGRRHALGGFRGLAAGAQDQYGRECEGVAPGEVG

SEQ ID NO: 31261 - protein, 144 aa, Pseudomonas aeruginosa
LARRTTRTIPGASARRRRSRGGNRPNSTSSERPMRNTAVLVAGSNSLARLMAVEMESSAGDRWAKISWARAVGSMLRPVRTNSGSSNSVRRRDSAALMAGWPRNSFSAARVTLRSCIRVSNTISRFRSTRRRSFRFMAFLVSRG

SEQ ID NO: 31262 - protein, 351 aa, Pseudomonas aeruginosa
GYSPRDALQRFAMSRVIRFHQFGPPEVLKCEELPTPAPAAGEVLVRVQAIGVSWKDVLWRQNLAPEQAALPSGLGFELAGEVLAVGAGVSDLPLGSRVASFPAHTPDHYPAYGDVVLMPRAALAVYPEVLTPVEASVYYTGLLVAYFGLVDLAGLKAGQTVLITEAARMYGPVSIQLAKALGARVIASTKSAEEREFLREQGADKVVVTDEQDLVLEVERFTEGKGVNVILDELGGPQMTLLGDVSATRGKLVLYGCNGGNESAFPACAAFKKHLQFYRHCLMDFTGHPEMGLERNDESVSKALAHIEQLTRDRLLKPVVDRVFEFDQVVEAHRYMETCPKRGRVVIHVAD

SEQ ID NO: 31263 - protein, 269 aa, Pseudomonas aeruginosa
REGNEAREGSGQAGGREDLGDPHHRQSHPGQGMDRVLQEGRRAQLFPGRRERRGDVVPPARRRGQGAARAGHQVRGDPSLGAASRGRHWPALRARASSSANRYWPRASAVWPLSGASRQLARPMVSRASPASRVCPQVGQSAGVTQAAPRMRKRASRPCSRMVADLPSSMSSRASRARRRQGSAAGSSTALSWMRSALFAPGRRQPRLASSCIATTVQSKRRSPASAANARAAQSGNRARVRKIMGYSGGGQRRREDRLLQVARSTGPT

SEQ ID NO: 31264 - protein, 630 aa, Pseudomonas aeruginosa
NFGVGIMILAKDVSYYQQEALRKAREGHTHLPIAVTATRLGDGTYKVLSYLADDVWRFPNAIFPPGTADHDKCIRFGKIPERWRSVLKIVMLEYYLNGIEGRVRPVGSSLISFFKNVSLFLKFAGVYVECLSEISEFLCMQYVNYLKNSRSRSGDKFSKSYLCTRLSSVHTLHLLSKVTTTPMVHPWPESSATELSGANRAHWAQSKTLPIPDNKLAEIFRAAVSRLERADETLALAEMVSDWQAQYSYSGTVNAKLAATGYRGGILGLRLEKNLLLDACSIVILLTSGIRVSELMSLKVGAHYVRDGEDGTKFYWMSGVSTKTKEGKVDWLVTKLTHEALDVAGKVTAEIRAELNDRYSLAKSANNLIEMHDYEAHLDSLFLGWGGHAHKLQVFAAQTIRARLKRFMLAHNIDWEVAPHQFRRTFARYVARSQLGDVRYLRDHFKHWTLDMTAIYTEDQVRDKELFDEIYVAMRHEKMLVLESVFEEDALVSGGLAETIRIFRSSDEAIRTYKSRREMVQFVSEVVHLRSTGIAWCTADSTGCSGGSVLDKTRCGDCSKSLIDESRLPHWVGIYTQMLELKAIANDCGPGAGARIDSDIRRCEVVLQELGADIEELKLGVLLERGLRHA

SEQ ID NO: 31265 - protein, 388 aa, Pseudomonas aeruginosa
ALGSALVPNKEAFMENIIVPTSVRAQLKRGLLEVKVEDTVLPPADLFGFAERRNPKRAFLFVSKVLGRHIPVRPSVMAASFESLAAEIPPDLPGPVLVIGMAETAVGLGAGVHRAFSATRSDSVYLISTRHPLGTDLFARFEEEHSHASAHLIHMPVDPEIREAMLQARSLVLVDDEASTGKTFVNLHRALVEAGLSKIERIVTCVLTDWSAGAVRKTIGESATAVSLMQGSYQFHENPAAPLPEMPDVGAVSIGEWPLSADKDWGRLGVRRVDDTLAPDIRVHPNEKVIVVGTSEFVWRPFLLAERLERAGVDVHFSSTTRSPIALGHAIEHALSFSDNYGLGIPNFLYNVKPGQFDRVLICSETPEQAAPAELVAALNAEVIFDGH

SEQ ID NO: 31266 - protein, 82 aa, Pseudomonas aeruginosa
ARQVARCENRRNGQWRAQCPPGRGLLMSIEMLEAGPKGANVLSVFDFDGTLTRHDSFVPFLRFAFGTREFTQRILRLGAAHP

SEQ ID NO: 31267 - protein, 204 aa, Pseudomonas aeruginosa
RSTRSVSMAITLSKNQSISLEKTAGSGLTSVSLGLGWDPVKSGGFLSKLLGGGNDEIDLDASCILLDGNMKPVDLVWFRQLSSKDGSIKHSGDNLTGEGDGDDETINVDLQRLPASVQHLVFTVNSFRGQKFDQVENAYCRIVNNSKSQELARFNLAEKGQHTGVVMASLSRKGNDWDFKAIGQSTNGRTADDLVNLAIQAVRA

SEQ ID NO: 31268 - protein, 453 aa, Pseudomonas aeruginosa
ACEITVMGNGMKLKSLAMAVPLALAGCGFVNDQKLNFAHQEYMQECFATISNSCNDKAIDYNIMLLETIKDKMIEAGPERLDLKGESAERFEDHVEKSIEKMVEHFEVMRPGFFTRVFMGRFEPFDGKSVRILEASDADELFSVILEEYAKRLLENRKKLQEIWEKTPNMVSEASEPVGALKEEPVQSASQDVEANGLKVAVDAAIIEHAQQNAASEYGEARRYLQVDFDGNGSTDAVVMYTLEPTNGGNYSNQYLVPLIRNGDAWEAKTRLDIMNSASDLADEGNGVLSYIELSHGPDDADCCPSMETKRLYKWNGSVLQEYKNDGAVPTQASSKSLAEPPFYSVLTLNDSSDEKEVTTKRILECSMASKLVGQLDSIDIIADKINRTGLANAINPNPEIMADYHQMIKKDWSLKDMNRASQDEYLVGIYNSEFCHKLHEQPAIQVSDVPGD

SEQ ID NO: 31269 - protein, 406 aa, Pseudomonas aeruginosa
FQPIRTRARAETIPLNNIAKPEGNCMKVVIAPDSFKESLPAELVAEAIAQGVRDSAPDAEIVCMPMADGGEGTVDAVLAATGGERRVSTVQGPLGAEVQAAWGWLNESRTAVIEMAAASGIHLVLAAERDATRASTFGTGQLVQQALNSGAQRIIMGFGGSATNDGGTGMLRALGARFLDSAGDDIEEGGLALKALRQIDLSGLDERLHKVRIEVACDVNNPLTGLHGASHVFGPQKGATPDQVLALDEALNTYADIVAALLQKDVRDFPGAGAAGGIGFATKAFLGAEFRPGVQLIADLSGLSQAVQGADLVITGEGKLDEQTLFGKTPAGVAVIASAAGVPVVAIAGTLGVGYQLLRDIGIVAAFSITSGPMTLESACSDAATLLRHRASDLVQLWKVARVGGS

SEQ ID NO: 31270 - protein, 80 aa, Pseudomonas aeruginosa
AGYVGKRKQIRRELFLIEMGLVVSWKNLIALIDSHYPEEKGIRPAYPLMAMLSVHLIQNWARCLYCRQDLLKESSDWSSV

SEQ ID NO: 31271 - protein, 303 aa, Pseudomonas aeruginosa
ALDAHRHADRSQSRPDLCAGATPIDGRSARKRPPRAGRGEDLGMIKSAEEIQRMSVAGALTAKVLEALDEVVRPGISTAEIDRFCERYIVDTLAAIPGSKGQYGYPFTVNTSVNEVVCHGWPSAQQILRDGDIVNVDVTVIKDGYFGDSSKMYRVGAIDRQAQKLLDVTRECLYRAIRVVRPDATLGDIGHAIQSHAEANGYSVVREYCGHGIGRKMHEAPQVLHFGRAGAGARLKAGMTFTIEPMINQGGHAVKLHKDGWTVTTRDRRLSAQYEHTVLVTERGCRVLTLRDEEREALADLAG

SEQ ID NO: 31272 - protein, 133 aa, Pseudomonas aeruginosa
PRFPAPTGAATRRTSSCNASTAPPGPTRSNWRPTSSASKRPRSATIAASASSSTCSTCRKKRRAWCSGTRMAGASTRCSSSTCARSSATMAMSKCVPRRWSTASSGSVRATGRTTPRTCSPPPRKAATTRSSR

SEQ ID NO: 31273 - protein, 795 aa, Pseudomonas aeruginosa
ENRMKFSEKWLRSWANPQVSHDELVARLSMVGLEVDADLPVAGAFSGVVVGEVLSTEQHPDADKLRVCQVSNGSETFQVVCGAPNVRAGLKIPFAMIGAELPGDFKIKKAKLRGVESFGMLCSAKELQISEENAGLLELPADAPVGQDVRTYLELDDYTIEVGLTPNRGDCLSLAGLAREVSAIYDVPLAPVAVDAVAAQHDETRPVELAAPAACPRYLGRVIRNVDLSRPTPLWMVERLRRSDIRSIDPVVDVTNYVMIELGQPMHAFDLAEINGGVRVRMAEDGEKLVLLDGQEITLRADTLVIADHQRALAIAGVMGGEHSGVSDSTRDLFLEAAFFDTIALAGKARSYGLHTDSSHRFERGVDSQLARKAMERATRLILDIVGGEPGPIVEQVSEAHLPKVAPITLRAERVTQMLGMPLDAAEIVRLLQALELTVVADGEGQWSVGVPSHRFDISLEVDLIEELARLYGYNRLPVRYPQARLAPNNKPEARAALPLLRRLLVARGYQEAITFSFIDPALFELFDPGTQPLTLANPISADMAAMRSSLWPGLVKALQHNLNRQQSRVRLFESGLRFVGQLEGLKQEAMLAGAICGKRLPEGWANGRDGVDFFDAKADVEAVLASAGALGDFSFVPGEHPALHPGQTARIERDGRLVGYLGALHPELAKKLDLEQPVFLFELLLAEVVDGHLPKFRELSRFPEVRRDLALLVDQDVPAQDILTQIRAAAGEWLTDLRLFDVYHGKGIDPHRKSLAVGLTWQHPSRTLNDDEVNSTTQNIVTSLEERFNATLRK

SEQ ID NO: 31274 - protein, 101 aa, Pseudomonas aeruginosa
RMGALTKAEIAERLYEELGLNKREAKELVELFFEEIRQALEHNEQVKLSGFGNFDLRDKRQRPGRNPKTGEEIPITARRVVTFRPGQKLKARVEAYAGTKS

SEQ ID NO: 31275 - protein, 682 aa, Pseudomonas aeruginosa
RNRKPAQERTGRRASTSLRRRGRLMDAQRFLAEFGHIANAPGGISKLRELVLQLAIFGKLTERVADDTSALELIEANKISQESLVAQKLLKRRLAPKPVIESDHPWMLPAGWAWTRLGAVTNYGDAPKIEFEDVKEDTWVLELEDIEKGTSRLIAKVLARKRRFKSTKNGFPAGAVLYGKLRPYLDKVLVADSPGVCSTEISPISFFENIDAGYLRWYLKSPYFITYADSSTYGMNLPRLGTDSAREALFAFPPQKEQSLIVAKVDELMALCDKLEAQQQARRKLQNVLRQSTLQAVASATSPHELKATWARLSENFGRLFHTPEDVDDVVAELKNLAVRGLLAEASEAPPDLDAIKADCSRLRAQYITGGLIRRQKLVGMAECEEIYPDHWAVTAFDEVAVVIGGVTKGRDLRGKQVMVCPYLAVANVQRGHFKLEGLKSIEIAADELAKYQVHEGDLLITEGGDWDKVGRTAIWRGGIENCLHQNHVFKARVPSGQLLNEWVELVFNSGIGRDYFAGASKQTTNLASINMTQVRSFALPIPPLDEQQRILSVLSELTTHCNKWRRQLERKQAMSALLAGAVVSSFTGITIEQEEEPMKAPQTELIAPLRLGTAPDIKAQAPLATTLARHNGEMSAKDLWQRFGGEIDAFYAQLKTEVARGWILEPTPAEMREKPADTVSA

SEQ ID NO: 31276 - protein, 292 aa, Pseudomonas aeruginosa
VIWIDLKNKYPTTAIPNWDPKATAQQWIPWTQERWDAWLARSKQLVAQLAALDAAGQREERNALIDANSGHWGELKDWLLALSAGKCWFSEVRELYSHYDVEHFRPKKEAKALDSAVRDGYWWLAFDYMNFRACGNVGNRKKGGWFPLKDGSLCSTFADQCEESETRYLLDPVDDDDVDLIAFDEEGKVIPMPGTSEWDQQRVQQTVTRLKLNDHVPLAEERRKVWQKVDGLIEDFKAAKARCGGNNPAAKAKLLEVRSNIREMTSRTAELSAVARWCVLFRNDPLLSKLVS

SEQ ID NO: 31277 - protein, 79 aa, Pseudomonas aeruginosa
SDCIGLRELMRIIRLKEVIDSTGLARSTIYKLIGEGEFPKPVPLVGRSVGWVESEVHEWIRSRIAQRDLREVSIASSTL

SEQ ID NO: 31278 - protein, 90 aa, Pseudomonas aeruginosa; identical to SEQ ID NO: 18832

SEQ ID NO: 31279 - protein, 268 aa, Pseudomonas aeruginosa
AEPARCVPRAPGGRGPGSVRGCSLRAWRGPATAAAHAVRGRAGAVAVRSARPPPAGRRHGSAALAWRRGTAAASGPGAGAAPRANSAGYRPGLPARRGRASGRRPRSSPGVRRGLSAGRSPLRRRRAGCRRRRAGWPGRWRRRAVAPAGCLRSGPVARGGPAARSFPPGAPGCRCPAPPGAGAGPGSPAAASLSPARSVRRAGAGSSARWPRPRGAGSGGSGPVRLPAPRYAPPGARAGAPSPGRRRLRRTALRAARGCCGSPVRGRG

SEQ ID NO: 31280 - protein, 399 aa, Pseudomonas aeruginosa
RAVRDLTSLWASLALKRQPGDKPGRRRASLAGLHRVPGARAHAVDLLRHGLEGEQLGHLLLRRVDRRVGLDLGVHQRVGGQVAVGVVHMVADRGHHLGTQQVVHEGVAGLLVGRVDRHRDHVEPQRRAFLRRRVAHFHAVVGLLGAGRGLQDVAGETDHHADLAVGQVADVLRGVEVADVRAHLQQRRLGLLVVVGLLAVVWQAEVVEGDGQQLGAVVQHRHPALAQFLHVFGLEEYIPGVQRRVVAEHRLDLRRVVADAGGAPEVGEAVLVARIVDLQGLEQHRVEVLPVGQLGLVQLLQGAGLDLLGHEVVRREYHVVAGLAGHQLAVEGLVAVVDVVGGLDAGFLGEVRHGFGSDVFGPVVDLQVVRGEGCAAAASEGEEGEGSDAGLHCCRCPVG

SEQ ID NO: 31281 - protein, 145 aa, Pseudomonas aeruginosa
SCCCCWTSAARWTPTSRSARSCSRPARPSSSTWSISTSTTSSTSRCGRTTCAAAANAPPPSTCCTSTVRTTRWCSSATRRWRPTKSPRPAAASSTGTRKPVTSGCSASWRSTRSSSGSTPIRRTPGTTRRPPAWSANWSRNRCIR

SEQ ID NO: 31282 - protein, 168 aa, Pseudomonas aeruginosa
WRMRTSTPALWKRRAAASTRNSPRVTRWWWRRCSSQDSSMKNSSHRRRLPLSWTSPQDTAPLRRRMARTSTIAAWNAAASCGSMSYSRVTITGPRSWSTSSSTSGAGQCSDGARSSASVTGSRQRSDANRPSSSAALAQSRAKVIDRWLATRPHRAPPAAMLPKNTRM

SEQ ID NO: 31283 - protein, 135 aa, Pseudomonas aeruginosa
RQPARRAPNRRSAGSTEGTASRFQASSTAITAKKERALRAKVSQGPTRLTSTPAMAGPTARARLTPTLDSATAAGSSSLPTSSGVVALQAGIISAVPMPMHRVRPSSSQTLVNWSRVRLASRVATKAIHNCTPSR

SEQ ID NO: 31284 - protein, 145 aa, Pseudomonas aeruginosa
AGATPGSRAPWLPVSRRGTARCRPAPGKGPGGRPVERGSSGKLRARRAAKGPPGYVRKRSRNSRMRPRNPGSRSPVRWSGARGCARGRVPRRHRRTGGPGRSAARLAASGRVPWPPATSPAAPAAPADRACRTRRRHRRPCRRPP

SEQ ID NO: 31285 - protein, 137 aa, Pseudomonas aeruginosa
PTANASARIRPSECRPCRSGPPGGTAAKENEDEALRIVAGRRTVGGDRLQPAAGAFAGSAAGGAGGVARHPARRAGHPGRQAIARRLRVRLGLRQGGFGRPCAGATTGSASPRPGRWPVGKGKGLSVISSSNSAVIW

SEQ ID NO: 31286 - protein, 591 aa, Pseudomonas aeruginosa
CWAATNRFRRSASPAAFPTSRISRGSFSGWPAPRPRPGVGSSGSAPTQRCEPRPCVTDGTEAAGCSARMPWLRRSPLAAHFATEQGIADESSTPGSRRNGVAHAPGAGRVQFAVGGAAAAQPRRSTGEDRPPDAGHGARSPRVGQRYLRGLFRPADLPQRRESLCGAGGDRAGVHLPGRPAGGRPGQDRHPRGRASCRQAARAGVPGQLGAEYQVARWPHLQPAPGRGAHGEGTERDIRRFHRHRAHGRQAVRRLQPGTHRRADAGQHRFRRAARGRLSLSAGRQHPPRGVQPARRHVFRHRPPAWLSGGLPGAAVPLRRLQRRLVCQSQRRVPERGESRLGDSAGAGWRSDPLRHAHAGLHRTGRAQPRQAPGHERRGDPPGAGAGRQPGVRRQRAVPQGLRPGRKRHRQDIAPRRAAGDRPGEPEDHPQADHRLVRQARRRTLPALHGARAETLSPSSRGSNLAPPRESAVLSAKLMEKQRMKTRYSAEAPARDELDRLAGPTLVEFGTDWCGHCQAAQPLLAEVFSDYPEVGHLKVEDGPGRRLGRSFQVKLWPTFVFLRDGREVARVVRPGSASVLEEAFESLVGEG

SEQ ID NO: 31287 - protein, 493 aa, Pseudomonas aeruginosa
RAITNSDRNIRNILRGFQVAHKDRSFAVFRLEALYLRSFSYVFDVFSSLSRRGAIACRNAFRGLIFLTTTNIVVVTERLFSGYPVLSLQEPPMKQRILIVGAGFAGMWSALSAVRQLDRQGRDDVEVAVLAPQPELRIRPRFYEPDVQRMAAPLGELFAAVGVRFVQGSAQRIDVAGKWVEYRDAEGTLAQLDYDRLVLAAGSGVWRPASVVGIDAAFDVDQLEDALRLEAHLHALRDLPDSPARNTVVVAGGGFTGIETATEMPARLRAILGEKAALRVIVVDRGAAIGASMGADLSGLIAEASAELGVEWCLGRSVAAVDAEGVTLDDGQRIEAKTVVWTVGVRASTLTGQIPGERDAQGRLHVDRNLKVLGLDDVYATGDVARAATDELGNHALMTCQHAIALGRSAGNNVAADLLGVEPIPYSQVKYVTCLDLGGWGAVFTEGWDRQVRFVREEGKKIKTEINGVWIYPPAADRAVALAAADPLIPVVA

SEQ ID NO: 31288 - protein, 234 aa, Pseudomonas aeruginosa
GRSWRCSRLRSMVASGSGCASGAPPGRAAARARPRAATSREVLIRLSRYGSKRRGQAGIEGPSGLVVGRRAGPVDADHALGIAGAEQALVEQVVDAGAEAQVLAQPIGAAKAGDGVGRELVVGAAGDTVAVIVVFLRLLLAVPGDRGLQREVVGGLPVEHRVEGVARRHREHVAGFLVLRLQHVGEVVAPLQAVGQGQGQGAFEALDHRLGHVLPLVDRRVGVVALAAAGVVDR

SEQ ID NO: 31289 - protein, 134 aa, Pseudomonas aeruginosa
QAGFDLVLVVVAEVGQPRYQAVVAVLDAQFLVHAGLGLEAVVAAQVATGALPVATLATAVQQVFGVQLVQVGGLVGAGDTGLQGDPLGERVGQVQRWAPVIADDVVVVPAQAWGEHGAGHQLDVVLGEQREDPR

SEQ ID NO: 31290 - protein, 779 aa, Pseudomonas aeruginosa
FTFVNISFLPGIGQWANAPQRARSGNTFRQSRRCFGFGSGLGSAGPQEAGRSVVAIGQPFATALGCTIIWRAAGALFGPPAAGDYQGRFPMLFSQHTRLVHVDSPLGPEVLQLQRLEGREELGRLFSHELELVSSNPALPLDALLGKPMSLALELPGGSRRYFHGIVARCSQGAGAGQFASYQVTLRPWLWLLTRTSDCRIFQNQKVPDIIKQVFRDLGFSDFEDALSRSYREWEYCVQYRETSFDFVSRLMEQEGIYYWFRHEKKRHILVLSDAYGAHHSPAGYTSVPYYPPSLGHRERDHFFDWHMAREVQPGSLSLNDYDFQRPGTRLEVRSNVGRAHAAADYPLYDYPGEYVQSQDGEHYARTRIEAIQTQYERVRLRGCARGIGAGHLFHLSNYPRLDQNREYLVVGAEYRVVQELYETGNGGGGAQFESELDCIDAGQAFRPLPSTPVPVVRGPQTAVVVGPKGEEIWTDQYGRVKVHFHWDRHDQSNENSSCWMRVSQAWAGKNWGSIQIPRIGQEVIVSFLEGDPDRPIITGRVYNAEQTVPYELPANATQSGTKSRSSKGGTPANFNEIRMEDKKGAEQLFIHAERNQDIEVENDETHWVGHDRTKTIDHDETVHVKHDRTETVDNNETITVHANRSKTVDRNETVRIGMNKTETILMASLQNVGMGRMENVGLGYSLNVGMMMNTVVGLNQSTQVMKKKTLSVGDSYEVSVGGSDDGSKITLDGQSITLGSQRIELTADREILLRCGQSTIRLTPGEIEILSPNVDINC

SEQ ID NO: 31291 - protein, 392 aa, Pseudomonas aeruginosa
AAGGCPVAAFPKEGWIDERPTGFPCRRESLGRGYLHRLAHRARRQQRGRPGRPGVRLRAVGGQAGQPDARQQAAAGRGRFRPGGAGHLHLRPWLPVEQPPYRPARPGLVAAGREHAPGTERRRLRAGRRPGPPDRLSCAGSRCPALFRQRGAVAAPRRFERRRSAGLARALGGGAGRTADAGGLRAGAVRPQLPAFPALPRRYLAPAGQLRPRRLPHRVPLERTWPAHRRARQRRAQLCAGLPASLRAERGRRRPASVRRDPGQPRRTASGLHRSAEPGARLAGALPVQRQRRSDRRARPSWPGGPGIRLARAHAGRPRRTGWAGGSLRVGCPCSARAGREADRGGRPDPYLPLPARCHRGQRQPRPRRTLRVRRRGWAAALDRAGQGRRQP

SEQ ID NO: 31292 - protein, 330 aa, Pseudomonas aeruginosa
RVVHPGAPARAAGTPAAQPPASGRRFRLAARLSLRRTWTTGRHRRQPVSVGALRIRPRRSPAGQPARWRGGQHLPIRRRRQPPGGRRRVRARGRSPGIRRERTVPLRFQSLRGAREPGRRRPGALGRQPRGEDRRQPLSLRCAGQPGRAYRRRRRAPAPGLRRRAAPGPSDARLRRRHAAGGALPLRRAVATDRQGGAARRCRAAGALRLGRRSPMRRSLCAGTAHHRSRTGRFRPVAAPGAGLRARSPGAAATAPGVRRRRPAAAGAMRAGAGRGADRFFPHRSPRYPPAAERRTWPTALAGRSGRLAGGSAGTTAGCAADPLPGAVPR

SEQ ID NO: 31293 - protein, 262 aa, Pseudomonas aeruginosa
RKRPLLQPLPLIPAGSRVLCQPGPARPGRWPQPLCLCAERAHDGVRSHRPDHPAGGDRRLRRPRRDRSGAGRRHRAGDADRQAGAGADEGQLGQRSRPHRYQVEVHRHQLETRRRLGGHRHRGAGHAQHRQDRGAVRQGDQDPFRTGGQHRQPRGQAGRAQGRPCRYHQEGRGHPGRLADGQADRQMPAEGRRRGVPAAMIKHYLLMTLVCIPLALLYVCLEWFFGNTWVTVGVFFGVLVVLRLGLYLYRRSKGIRDGYLDE

SEQ ID NO: 31294 - protein, 374 aa, Pseudomonas aeruginosa
GRPGIAEHRPMQGLFVNGSASLPPPMLSRRRCWRRSPGNLANCLSSLPRSEEPTMHDLPTYDDVIAAAARIAGHANRTPVMSSRTLDEELGAEVFFKCENLQRMGAFKFRGAFNALSRFSAEQRAAGVVAFSSGNHAQAIALSARLLGIPATIVMPADAPAVKIEATRGYGGQVVLYDRYTEDREQIGRDLAQRHGLTLIPPYDHPDVLAGQGTAAKELFEEVGPLDAFFAPLGGGGLLSGCALAIRALAPACRIYGVEPEAGNDGQRSLRSGAIVHIDTPQTLADGAQTQHLGNLTFPLIQRNVDDILTASDAELVDGMRFLAARMKLLVEPTGCLGLAAARQRKDELRGKRVGILLSGGNIDLARFCALLGG

SEQ ID NO: 31295 - protein, 390 aa, Pseudomonas aeruginosa
EPVGGSLAIRMLAGGYPDCPGARGGRRRAPRRAARGYRSGPLALPGRASGEPRFHPLAERAGRRRGVSRRGAHQVDAGVGVQLPLRQHPYQPAGFEVAAHQPLAGGEDTQALACGAEQGLVVVADHRAAYPHGLLFVLAGQLPLRVRVQSAEAEAIMCRQVGRDTRYPMPLQVVGSGAEDAPMGAQPPGHQAAVGQFADPDREVEAFRDDVDEALRIVGFQHHLRMRQGELRQQRTEPEPAHRRRQGDAQASAQLRGAQAGFVLGLVEQVDGLAEAARQALAFIGEAQLPGGAFDQADAEATLQCAEPLREHRGMALQGAAGGGERTVLGQGQERGDFIGLPAVERLHACASCGWVRARVPARLASVPPADRYAPRPPRPAGSAARPGAE

SEQ ID NO: 31296 - protein, 400 aa, Pseudomonas aeruginosa
PAAKPMNFIYQAVDRKGRRVRGELCLPTRQDALRQLQRQGLTPLSLEVKRRNLGSRRRLKAEELNMAIHELATMLAAGVSMADAVEAQERGARHPKLITALQAMANGLRQGQSFPVVLESAGLDLPRYVYQLVAAGEMTGNLAGALRDCATQMEYERRTRAELQGALIYPAILVLSGVLAVATLFVFVVPKFANLLNETAQLPWLAWAVLSIGVWSNESSGLLAFAVLLLAGGIAVALRNPALRAHALDQLVRLPVVGEWLMQAEIAQWSKVLGTLLGNRVPLVEALLLSAAGVRIARQRRTLERVTQDVRAGIALSAALEERQAVTSIGSSLVRVGEASGQLAEMLQSLATLYGEAGQARMKKALVLIEPLAILLIGSVFGLIITGVVLAITSANDMVL

SEQ ID NO: 31297 - protein, 177 aa, Pseudomonas aeruginosa
RAAYRWTPGTGLTCTATGRVPNNPSLSTARARMGSPVGKAWMPMSVTRPNVDQAAFTLLELLVVLVIVGAIAAVALPGLVRMQETWARRTALDDLFNQLQTLGYRVRSDGRELLIGESGAVPEQLLRLPDGWTVTARPPIRYMANGVCLGGKLQVHHGRATHTLLLQPPLCAPGTIR

SEQ ID NO: 31298 - protein, 370 aa, Pseudomonas aeruginosa
MIATRILRCIPISPPGFLPPRLWQGRGKDGRAQLEWVRRGTGLARRAPAQWIVDRAWCVYRCLDLNHVPRSDRYQALALKLAALAPFRRAGHYVAWRGGHALVWFWDEEVREAVAEDCVDQPRRYRCIPESLLQAPPRSIAEGETVRLLRVRSGLDLQVWRDDCLVLSHFFPSPPQPEQWVRLLRGLAGIRIPESLVAEPGESLGRPWAVPAAEATLLRWERWLPHGLIATLLLGCGFNLGEGLSWWWAERALRTQYDQLSDQVSPILSARNQALQTNRMATELGRALQHRSQVALLGQVAELLPKDSRLLAWRYRGSELELRIGTDSVDPRLYVRRFMESGSFEDVRVEPSQSEGLSLSLVLRTPGEGA

SEQ ID NO: 31299 - protein, 648 aa, Pseudomonas aeruginosa
IGLKIALISAKSRIQPVCGSTSPSMWMATRNEWPCRRPHLWPSGTWGRRWADSKVNSLKSSTVVRSGSGLSDNRNGGAMVAGLRAGPGLLRPGGRLPELQAARQARQVGAIQAQLACSRGPASLVAGQAVLDQAALVGVGGRAQRVTGRWRGGRGLDHAARWRGGFRGQVEILPMQGDDPRPLRIVAEGLERGAADQVLEFAHVARPAIVEERGLGLVVQAQAAQSQARSVFLEEVAGQQEDIAAALAQRRHAQGIDAEAMVEIGAEAPGTHFLGQVAVGGCDQAYVDAVLAIGADPLQLPALQHAEQLGLHRQRQLADLVEEQAAAVGQFELAAPFVDRAGEGAAHMAEQFAFHQGLGQRGAVETDHRLAAAHGMPVDGLRHQFLADPGLAGDQYAQVAVGDQADFFQQRLVRGALADHFPWPLASGFEIGLGALVLVLGAAGQVAHPLAGLDRGGGEAGEGLQGIQVGAGEARRIEGIQGQQAPGLVVEVQRTAQAIMDFQVAVEAFHQTVVGIGQAAVGGEAGRPAALQEGLEARMFADPEAPAEGVRAEAVHRQRDQVFAVQAQQRGGVAGQQVAQGLEQAAVAFVFRQVAGQVGNQRDQGGKQGVGGHFDLFAVLMTLNGCSHYDLCRPARPVNSGSLPWHAS

SEQ ID NO: 31300 - protein, 242 aa, Pseudomonas aeruginosa
SADHPFLPHHARRVPRGSPAVQPGPPGQRRPAAGAGQWRADVRQAHRPVAGTRPAGGQGGEQACLPAGAARTLSDRRHLPVAGDPRGPRRTDRHRRSPRSLGRGLPATGRPADRGRGVGVCRQRPGRWRLARRAALPRGTQAGGERGNHLVLPGAGGRPAAAGVPAGTVHRPAAGHRRRGSAPQLFAFPLPATAANTASASSARRVDGSPITCMTGSPRATSWICFRRLAISSCVTATSRWC

SEQ ID NO: 31301 - protein, 411 aa, Pseudomonas aeruginosa
ARCSACVDPVGRSAVQVLDRSRLMAIPPIWRLGFRPFFLGGALFAVLAIALWLAALAGLWSGWQPVGGWLAWHRHEMLFGFGVAIIAGFLLTAVQTWTGVPGLQGKPLALLAGLWLAARLAWLFDAPLALLLVLQLSFLPLLAWAIGRSLWRVRQKRNYPVVGLLLLLTLADALVLLGLFEGNDDWQRRASIAALWLIAGMMNLIGGRVIPFFTHRGLGRQQQVPAIAWLDNGILLGCVLVALLTAAGVTTQPTPWLAGLFAALGGAQLWRLWRWRDRGIWQVPLLWSLHLAYFWIAVAPLGMALWSLGLALAPSQALHALAVGGMGGLILAMLARVTLGHTGRALQPPAAMPWAFALLNLGCAARVFLPSLLPANWALPLAGGLWALAFLLFAWFYAPMLCRPRVDGHPG

SEQ ID NO: 31302 - protein, 487 aa, Pseudomonas aeruginosa
GSPARGRPVRWPSTGSGRPPRRLPRRDVGAAPPPVRGRSCADRPRRGYRAGRRCRGSALRPVSCRILLVGGGSVQRLQAFAEPAAVDQFEEFVAEPAAFRHRLAPVALAAVVVAEVAGEVLAVRQLGVRQARQVLARRRQQQHVLQAPGVATAPGQALVEPAGDHLVGEVRVEHHAAVLVGQVEMVVEQAAVAVGAGAGARQVADAFHDHRDRAGGEQRLAQVAAVQVQVARREVGQRGQRRRLAGVMQDHPFEVAVQMAAADQVVADHRGQPQAEAGLVVVGEAPVALHHHHVEAVQRVVEDPRVLAGEQVVEHRRALARDFGDAHALGKTLPGVQLAEAGEAGHGVGQAGTGEAPGTDGGADQRAFTRGARQPLAEDRQVQSLDAQRLWPAGGTGDDADVGRLQAALADAGEGAATGLEGQCGGLDLDGWHAGLLPCGPAIIGRVVAGPSAFERRRAPSQRLSVTLWRAPAMSLRQIQLQLRAPG

SEQ ID NO: 31303 - protein, 172 aa, Pseudomonas aeruginosa
RRDHQVLRRAEQERHRQASRLERPRYRAGRGIRPLHLPGRVARPAGREMGPGAGCRYRRRAQGPPGRLMKWLMRYAGIVALVLAVISLEAMARDLDQDEVLRLRQDGVIQPLESLMQEALGRYPGARLLEVELEEEDDVYVYEVELLTRDGVVRELELDARNGRILKDEEDD

SEQ ID NO: 31304 - protein, 214 aa, Pseudomonas aeruginosa
SRPAVARATATPGWPPDEVDPAAHERRPVRGAAGGRAGPRADRPVAVRPGPAALFRRQSARGGGEPAGGHGARAERHATGRATPQPGVPAPVFRALFRHRAGKGHLALTLPVGQRAGSAAQERAGAGPGRWARGAATAGVPRPLQAHGPEAADRGGAGLYADPGKLRPCAVDGSGRRRPGAAPGIAVAAPDRASFAASAGGGAPADRPAAAGPA

SEQ ID NO: 31305 - protein, 154 aa, Pseudomonas aeruginosa
PTGQPGSRGTGAAGGADQPPAGAHRGDPEAFAQRPGQPRSRPEDAAGGAGQPRRARGDGAPAGVATGPARTAGTDPAAPRSRVGQGPPGRRSAAWRTFRLRRGVAVAVRHPAPDPRPAPAGELERATGAAPAMGPRGPAGDARQSAGQRLQVGR

SEQ ID NO: 31306 - protein, 226 aa, Pseudomonas aeruginosa
RPRYPPRPAPGGARAGYPARRAGQRPWPGPGHRARHRRGLRWPPESRGQPAGRPAGERRVAVAEERPRRQGLTVLHHLPTLPARFPPALSLASRASCKEVLDDETADEYGPLALGADAAGAGVPVGRVQWTARGGAVAAVTRAGSLRAGRGKRVAQRARRAATGRDSGSEGGRGGSPGASAWLAALAGPPGDLGDLRPPGAIQAVNGQALNCSIRPCWWLARRFSD

SEQ ID NO: 31307 - protein, 438 aa, Pseudomonas aeruginosa
LTWADSSAWLDSDSVTSRIAATLRLISSATELCSSAALAICRFMSLITVTASPIRCSAATASSTCSTLPWAWRWLPCMASTTSRVPCCRPSITPRICSTESWVRRARLRTSSATTAKPRPASPARAASMAALSASRLVCSAMARITSSTEPISSLLLASCSTWPMALVRLAARLSMLCVVRSISARPSRVAWSAPRAASAAWAALRATSWAVAVISWDAVATWSISRNCCCMPALVWLEIAADWSAVLRASRTETFTSRMIGCSLSRKRLNQPASSPSSSRPVCGRRWVRSPSPLAMSRSMWATPRIGRVTPRALSHSTSRPSTAAPRPRPSSTQVPSRRMSSSCRSSARAGPSRALFGTSRSTPQGLAPGIGCNGCSTLRSSFSLNNRLLPAASSCRSSPACCGSALARFLPSRPASRLLPANSPAGLRMPTWPTPS

SEQ ID NO: 31308 - protein, 104 aa, Pseudomonas aeruginosa
SPRTCSCRWASATSSSMKSCWPTWRATASTSAGSTSPTPCSSQPWACSPGCSSRCCSATAASASTTCSGSSRPNASMSATTRRAWRWPGYPSSPRSSHSCGWTR

SEQ ID NO: 31309 - protein, 212 aa, Pseudomonas aeruginosa
PAAGRAIHRQCARGDPLHCRTDQPAGAQRGHRGGPCRRGRTWLCGGRRRSAGAGQPHPAEYPGNPGHDRSPAAGHQRRGRRHAPFRRGRRGHQQPGQPGRRFAGCHRPADRHHQRDERADRQRRRGTDRGGRGDQPQRAPDRRRGGQRRRRGPAGRADRPQPGATGPGPGPTGRSVPHLTLPPRDRCRQKSQPAVVRHRAFLSLFGGVGRQS

SEQ ID NO: 31310 - protein, 372 aa, Pseudomonas aeruginosa
TIHVRRLTNALLPTARWIGHARHETGIPDFSPVAGGGHARLRLALAAVLRRGVLGHHPGDHLRPGATPPAGAPEGSEEPRRADHPADLRADRDHPGDLHRRFAGAGRRERLPAGQVRRTELRRLPAAGGGCLAAIGAPVGGSASTWANLSSLQEKLSSVAMQASQVVATKAFSIGQNTLDFVISFGIMLYLLFFLLRDGRVLGRRIKQAVPLSQEHKHHLFAKFTTVIRATVKGNIAVAATQGALGGLIFWLLGIEGALLWGTLMAFLSLLPAIGAALIWAPVAAYFLLTGAIWQGVVLILFCVVVIGLVDNILRPILVGKDTKMPDYVVLISTLGGMALFGLNGFVIGPLIAALFMASWDLFTGREEEPQA

SEQ ID NO: 31311 - protein, 511 aa, Pseudomonas aeruginosa
IVKVISRLPSCKGGKGCAQPLLHAVHAGRGDVQHWLRVDPEQDQQDRQAEHHAQFAGIEAEDRLVGLAGAEVGAVDHDQRVDRGEDQAEGGDHDDHRDHLEGADQDQELPDEVAGTGQAQRRRGEEQADRRQVGHARPQAAHLAHVTGMQALVELAAEDEQRRGGEAVGDHLHHHALQRDLAAGVDADHHEAHVRNAGVGDQALDVGLREGQQGTVEDADDAEPHGDRREFRRGVGEQRQGEADQAVGGGLQEDAGEVHGAGGGRLGVGVRQPGMHRHHRHLHREGDEEAEHQQPFHVGAQLGLQQGGVVEGDHAGGIEVDEHQAEDRHQHHQAAGLGEDEELGGGVDAGLLAVIGTVSPQRDEEVHRHQHHFPEEEEQEQVDGEEHADHTAQDPQQVQMEEADAALDLVPGAEDREHAEQAGEGDHQQRQAIHRQVDADAETLDPQHLELQGPFRLAAGRGRQLEVAGGPDPKAQDQDQGHRKQRDPAGQGLAAVFGDPAEETADEGDQD

SEQ ID NO: 31312 - protein, 471 aa, Pseudomonas aeruginosa
PGQNHDRLSLSVNSLGQQQRAEQDGGSTHQGSGVPAQAAVLGEAEEVVSAAHAERNDAQGTVDGVAPQQLAEQQVGFHEQLVVQPVEAPGVVPPGTEEATRGALRQGADEAALAEEEQGGQQDTGDGDGTRGQFQAVLGFATCVADAFRQDASQRRGDQGADEGRQDDQHAERQPVGNPVAGVGFGLRLAVEGDEDQAEGVDRGQERTHQAGDQQFAMAAGEGLPEDLVLGVEARGEEGQGGQRRTADHEAGVGQRQLLPQAAHLEDVLLVVAGDDHRARGKEQQGLEEGVGHQVEDRRVPGADAEGEEHVADLAHGRVGEDALDIGLYQGGEAGQDQGHRADDADQFEDVRGQGEQAVATGDQVDAGGHHGGGVDQRGKPGSGRPWRRPSRSAAAAGRTCRPRRRARARVARVSQRLPSGNFCGASTSSSWMFRVPNCWNRMNRPKAMNTSPTRVTMNALSAALPLLRLL

SEQ ID NO: 31313 - protein, 98 aa, Pseudomonas aeruginosa
APPSGGLLWKLKMAQAALRAERPTEPTPTSAERFSDHLPRENDSSRKPTRGNRKVRGRRFIRASRWQRRYRGCGSGDTVAAGSPGRCSLRRPRGSAPG

SEQ ID NO: 31314 - protein, 496 aa, Pseudomonas aeruginosa
WPWFKSSLARCQRAWLIETHGSVGPAAGPRHDDETSPDGWPSGCKASGADRCRARRGRRLAGDARLEFGTEILEGAAQRLDGSRRVGAEGLAWAEEVDQLLEGLEVAGLAFAPLQGTQQLHAPRQAIAAGGAPAAGLAGEELFHVAQQGNHVDAVVHRHGQAGAHPGADLGDAAGEHLRIQVLREQEAGTGAAGLPGLELEAVAHAAGVVLEQLAGADAERQFPQAGVLHLAGEAHQLGAHVFAAGAGQGLVPVHAVADDGRHVAQRLHVVHAGRLAPDADGGREGRFGTRVGAAAFQRVDQRGLFAADVAAGTGVDEQLEIEAAAEDVLAEQAGGLGFVDGAVEVARRVDVFAAQEDVAAVGLQRARGNQHAFHQQVRQLLHEHAVLPGVRLHLVRVAQQVADVQRLVLRHQAPLHAGGEARAAAALEAGVLDGLDDVVLGHLGQRLARRGIAVLALVFLEPDGLGVFAQAPGQRMGFRRTRHAVGRTNGGKGHT

SEQ ID NO: 31315 - protein, 408 aa, Pseudomonas aeruginosa
IRLLWLMSAVHVSHNEIDATQVGDQVRDHAAVDHRGDLLQVREAGRPDTRAVAHGAAVAGQVVAVDTLGRLDHLEGFVGRHDRAPGNLQEVGDQGFDVLQRAFFRRRRGQRMVGLVRAFRHVLQALFDDPQALAHLAHLDHAAVVGVAVVGQRYLELEVLVAGVGAGLAQVEVATGGAQAGAGGAPLEGFLGVVLGDADGPAAQDAVLQGRGLVLVEALGHPVEELADQLVPAARQVVGDAADAVPGRVQAEAGDGLDHLVGALAVGEGEEHRGHGADVLDIGAQVQQVVQDTEELRHHDPDHVDPLRHLDPGELLHREYVGQVVHHPAEVVDAVGVGNETVPGLALGHLLGAAVVVADLRDAVDDLLAVQLQDDAERAVGGRVVRAEVEEHVVLVLARGASCPSLPA

SEQ ID NO: 31316 - protein, 202 aa, Pseudomonas aeruginosa
SAGPPVQVLLGGGQGVGIELGGARRVVLAQRMALPGRRHQHAGQVRVAGEGDAVHVPHFALVPVGVGPDTGGGGQVEVALGQGDLDHHVTITLQRHQVVEHAEVGARQAAAMGAQPLVDAVQVVEHHVGLGYLTEEGQDFDQSFARDPEHRHAGTGGLDGEGLGAKAGIQFDDDILVVCLVRRDVQSGVCSHGLGRFRSTVG

SEQ ID NO: 31317 - protein, 70 aa, Pseudomonas aeruginosa
TSPLSGLTAPHSGRSILVAPRTSAARRVLISTSPWSAKLTPALRQAARKLPSAMSSGSHWPLPSALKRAT

SEQ ID NO: 31318 - protein, 578 aa, Pseudomonas aeruginosa
QALEAFCHDPEMKNPGRSRGFREAGRADRGCPAGPCSLVELVHGVVFAAGLQSGFASEVLFMVVADVGARHVLVLDAGDALAQFLALHALHVGQHAFVGEVALGQVVGGQRGGVVGRQGDQVVEDAGVGRAIALEGADLLVGDLGQLGVVVLDAHQLVAVVGGNVLAFGDERIEHLLAEVQGPVEGRAVVVDQLGVRNHFADAIDHCLDLADVRLLGFDPEQVGAVLQRGDAVQDAAIFAGALAELEQVGSQALRTQQLAFALDHDVAVAQLGLGDFFAIQEGVVQVAQVARLVGHGDLLGQAGAQGVGTGDDHAIVHAQLEEGVAYGIDLGEEVDVRNGDLAVLVAALLLVGHLVLDLDAAGAGFDHLLGQQIGRLGVAEAGVDVGDDRHHVGFEVVDLGQQLGFLGLVASGAGSVQAGEQQVQLAGVSLAQEGVQLFDQAGNRGFLVHGLVRQRAEVGAQRGDHPTGQVEVALVGGLQVLLDRDQLLLPDEAVPATQRLGVDGGVRIVFGHVLAHDGRGVLGDIQAGLEAVLDTHASCVLGVDRAPAAAVLLFQRGNCLDLVLICGHGQSFKKCIG

SEQ ID NO: 31319 - protein, 438 aa, Pseudomonas aeruginosa
ARKCTASSSSASHSSSGGTDCSAMKTASRMRRSSALSFCQSATRTRILFICKLQTALFDQLRQQLTRIVIGQPLAEVFQMQRIGRADQLQQFLELPGQEYALAAGEQHQADVDLAPGQAGAGVAHQQRAILEGAEQLLFGDLLAGNQFGIARFGHELAEPSQQQALVAHVLLDQALQALQSVALDLVRIVAYRLQAGIGVALLVGEELAEEVGEMGQHFGGAGRAEADRVGHALVFGNAVVGEARGQVEHVAGLQDPLVALFEVGEDAQVGVLAQRAVAAAHLSDFPAPASVALKQEYVVVVEVRTDAAAGSGVADHHVVDPPAGQEAELLQQLGDFRDELVYRLHQQGPVLFRQVLVVLLLERATAHFPRGFPVFEDDARFHRLLQRQPGQLVGGQRAFEVRDRLADQQRFALPVVAEEFGSGQSAQKLQGSISIHG

SEQ ID NO: 31320 - protein, 413 aa, Pseudomonas aeruginosa
SARCVPACRPGLRIRRRRRGQSVAVADRSRASSEIPGFRRFDHAAAEADVAVVEHHRLPRGHRALRFVEHRAVAFGGFLQDAVLVALAVAHLGPQAARPLQFDRVDPVDSRGQQGAGEQQRVVVALADQQHVALQVLAEHVPGIVAGFLETADAEALALADGVVHQAAVATDDLAFDGLDVARLGRQVLLEEIGEASLANEADARGVLLLRRGEAMLLGDGADFRLLQFADGEQAAGDLLAAHRVQEVALVLVRVQALEQLGAPVAVAAPHIVAGGDQVRAEHQRVVEERLELDFAVAEDVRVRRTAGLVLGKEVLEHVIPVFRGEVRRVQLDADPVADGLGVGQVLAGGTVFGAVVLVPVLHEQAFDLIALLQQEQGGDGRVDAAGHADDHALAAWGGGGFRHSDQASRANS

SEQ ID NO: 31321 - protein, 834 aa, Pseudomonas aeruginosa
FFRVSLKPYNRRVLTKTASKAPAVRRKNSDLKDSTTASHAAAWRQQLHSRLKEGVLIALGALCLYLWMALLTYDPADPSWSHSSQVDQVQNAAGRLGAVSADILFMTLGYFAYLFPLLLGIKTWQVFRRRNLPWEWNTWLFSWRLVGLIFLILAGSALAYIHFHASGHMPASASAGGAIGQSLGRVAVDALNVQGSTLVFFALFLFGLTVFADLSWFKVMDVTGKITLDFFELIQNAFNRWMGARAERKQLVAQLREVDERVAEVVAPSVPDRREQSKAKERLLEREEALAKHMSEREKRPPPKIDPPPPPKAPEPSKRVLKEKQAPLFVDTAVEGTLPPLSLLDPAEVKQKSYSPESLEAMSRLLEIKLKEFGVEVSVDSVHPGPVITRFEIQPAAGVKVSRISNLAKDLARSLAVISVRVVEVIPGKTTVGIEIPNEDRQMVRFSEVLSSPEYDEHKSTVPLALGHDIGGRPIITDLAKMPHLLVAGTTGSGKSVGVNAMLLSILFKSTPSEARLIMIDPKMLELSIYEGIPHLLCPVVTDMKEAANALRWSVAEMERRYRLMAAMGVRNLAGFNRKVKDAEEAGTPLTDPLFRRESPDDEPPQLSTLPTIVVVVDEFADMMMIVGKKVEELIARIAQKARAAGIHLILATQRPSVDVITGLIKANIPTRIAFQVSSKIDSRTILDQGGAEQLLGHGDMLYLPPGTGLPIRVHGAFVSDDEVHRVVEAWKLRGAPDYIEDILAGVDEGGSGGGSFDGGDGSGEGSEDDPLYDEAVRFVTESRRASISAVQRKLKIGYNRAARMIEAMEMAGVVTPMNTNGSREVIAPAPVRD

SEQ ID NO: 31322 - protein, 271 aa, Pseudomonas aeruginosa
RHAPAGNRRPTEPEAAGTVPLAYRCAERAIAHFQRREGLAVRPGPGAGDHPEARSAPDPDAGAAALRRHLEDQRKLRHHLQGRRQRSRFRAQAEDQGHPLRHLASVVPQRQGERHADDRWRRPAHQHPVLRREDERGAGCQAIHLRRSAGRRRDPGVSASRGSVPQRARRAAPGGTAEARKPGRVCGAGTPAGPRQALARGAGAGRAALDDLLGPAGSRQDYPGAAAGAGVGRPFRDHFRGAVRGQGDPPGGRGGQAARGAIRAPDHPVRR

SEQ ID NO: 31323 - protein, 346 aa, Pseudomonas aeruginosa
GAPLQQEPAGCLPALCGRRHADLHWRDHREPVLRVEQCAALAGSRVCPQEPRRSRPAQAGGPRAERGQGPRQAQAEAAGGELPGSPGRRRRRWAAPAEPAGERCRPRRGRQRDQPRAAAESARRYPPTFRQGRRGVLRPDQRAAQVGARLQSRRGTLLVRAYARRRLRSPVHRPAGGAHGQRGGWQRRSSRPRPMPVGLGRAGAPGQPRRRAGGGPGHRLPGLCAEEQCGVQRVQRGDARRRRKRLAGSAIALAQRADQIDEEPRLWRGIPLRPRRAGCLCRRRGLFPRGSGAAALLSTGAEGPGTEDPRQAGTPGRAGSHQSPPTQKILSGMGSAELARLPRRRR

SEQ ID NO: 31324 - protein, 468 aa, Pseudomonas aeruginosa
SADMDFLPLFHSLQGRLALVVGGGEVALRKARLLADAGARLRVVAPQIHIELRHLVEQGGGELLERDYQDGDQPGCALIIAATDDEPLNAEVSRAANARGIPVNVVDAPALCSVIFPAIVDRSPLVVAVSSGGDAPVLARLIRAKLETWIPSTYGQLAGLASRFRHRVKELLPDLQQRRVFWENLFQGEIAERVLAGRPAEAERLLEERLAGGLAHIATGEVYLVGAGPGDPDLLTFRALRLMQQADVVLYDRLVAPSILELCRRDAERLYVGKRRAEHAVPQDRINRLLVELASQGKRVLRLKGGDPFIFGRGGEEIDELAAHGIPFQVVPGITAASGCAAYAGIPLTHRDHAQSVRFVTGHLKDGTTDLPWQDLVAPGQTLVFYMGLVGLPVICEQLVAHGRSAQTPAALIQQGTTAQQRVFTGTLENLPQLVAEHEVHAPTLVIVGEVVQLRDKLAWFEGAREDA

SEQ ID NO: 31325 - protein, 352 aa, Pseudomonas aeruginosa
KAPLSGAFAFSGRRSSALPGRFRSLPGVDSMTLRFRRVMASDHEEAVGSVATELLHQAELPVQVALHRFARIVGTFVGAAVAVNARRRQQAFAVFRRQARGDPGAGAAVEKEHRLAAECLDFRHGEACQQAAAAGEYVALGRAQPFQCLLQLAAQYPGGAGDVAFRIVGAGGEVEHPGARFAQPVGEGGRVDGVGPGLPRQRRAPGAPLAEVGVGESVQYRDLPAHLGQPGGAHVGAYAIVVHQYQARAAHAGDMVGFLNQLATGRGAGARQVTGFVFLGRAYVEQVGGAVVLVLPLGQTGQVEAFDAGAVGDGTGALGGGLACVLRDRTEASRLAVFQLLTGQRPADGAVA

SEQ ID NO: 31326 - protein, 232 aa, Pseudomonas aeruginosa
CRHRVGDAGVEQRLGTDDATSAPGTVDYHPGARVRRQFGDAQHQFGAGHADAAGDTHGLVFVETTGIQDHRVGPGVEQSLYFLRGQRWRVALGLHQFAEGLARHVHIAEQLAAGVAPTGQAAIEQGHVAVAEVEEALRGDRRQAFAVVVDGNRRVAARHPGMDLQFQPGQRQVGGEQGMGLGERVLLAHVEQRQLPAGEESGADIVEGAYGDLAHAGFSFDRSQILGKRLLE

SEQ ID NO: 31327 - protein, 308 aa, Pseudomonas aeruginosa
YARNAIGAGPMKIDDIDAFVAVIRNASLSQAAESLGLTQSAITRRVQSLEESLGVALLDRNTKPLKPTASGLRVYEQCRRVLREVDGLRELVAGDATPSGVLRLGVPQSIGEVVLLDALRRLADEYPELRAQVGTGWGSHLLARLENAELDAAVVLFPPSKVFPEELGATPLGRMELCVVVARDSAIQARRLLDCYHHGWVLNPDGCGFRAGLQRALADQGLGLQLNLETFGSELQLGLVAAGRGLGLVPAPALARSRYRDQLRVLQLEDFQPLIQLWLVRPRLLGNLETPARLFGRAVAEGLDMQAG

SEQ ID NO: 31328 - protein, 389 aa, Pseudomonas aeruginosa
EKHPCRCFSYNDSRQPYQSSGPGEGNSVSVEILGMITATPSSEVDQPLGEAVDAGFVRRFAQAHEDAGFDRVLVGYFSNAAEGAVVSSFVAAATRRLGVLLAYRPGVIAAPLAARQLATLDQFSEGRLALNVVSGGNDEDLARDGDYLDHDRRYARTDEYLQALRAIWTATGPVDFDGEFYRFQGASPAVRPRQSPHIPIYFSGSSDAAIEVAARHADTYMLWGEPLAAVDGHIRRVRAAAKAQGRDPRFSVSFRPIVADTEEAAWKRAAEVLEQVRENRARLGLPLRDHQPQNVGSQRLLAAAEQGEVLDSRLWTGVARLTGARWNSTALVGTPEQVAAALGEYYRLGVSTFLIRGFEPLGDAVRYGQGLIPAIHDHIARLPLLRHAG

SEQ ID NO: 31329 - protein, 317 aa, Pseudomonas aeruginosa
GAPMKLKQYLLTSFATLLLGASLAQAAELPTLRVGDQNYYNVRASMEASGVLEGAPYQVEWKHFQSAAPVAEGLQAGALDLGFLGDSGFIFLAAKGAPVKLVGVSRQNPDTIALLVPKDSPVRSIADLKGRKVAYWPGAWSQQLTLRALEKAGLPKDYVEFVKLMPIDAAAALPRGSIDAFPVWEPYISQQIVVSGARPILTARDLMPGLSSIAANAASIEPRRAQIADFLGRLRKARAWVEAHKEQYADLWAQKANLDRAVSRHWIGQAGMSVGPVYAQAATDYQETADFLLQTGALPKPFDTSTGIDTSFNEAFH

SEQ ID NO: 31330 - protein, 363 aa, Pseudomonas aeruginosa
VRTMSIQFLGMIGHRLASETLAPVGPILDKPYIAAFARAHEEAGFDRILVGYWSDQPDGFLVAAAAGLATSRIGLLLAHRPGFVAPTLAARKLATLEHLLDGRLAVHIVSGGSDADQRKDGDYLDHDQRYARSDEFIELLKRTWTSTEPFDFHGAYYRVEHAFSAIRPQQKPHIPVYFGGSSEAALKVAGKQADVFMLWGEPLAQAAETISAVREQARSNGREVEFSLSFRPILGRTEDEAWAKAEAIRASAGARLGEAGFPKGKPQSVGAQRLLKAVEQGERLDERLWTGIARLVGGGHNSTALVGTAEQVADALLAYYDLGVRNILIRGFDPLADAVEYGRELIPLTRAKVAERERRRATA

SEQ ID NO: 31331 - protein, 134 aa, Pseudomonas aeruginosa
RGVAWRSLRRYRRERPRVARRLAARARAGQSRRAVGEPAEDAGGARRDRRPAPAEPPAARCRVLRTVARQRLRAAQGRGHRQRVGGGRGGPGTERQPRPQPAQSATAALPRRALRTCPHATGKIASGARRGGRR

SEQ ID NO: 31332 - protein, 689 aa, Pseudomonas aeruginosa
VFETYLPRFSTLALSATAPAERIAQDSPGSVRSCLEIAHETTPVCACRPAGRDPAGWSRQRRRPHQPAPGRCEGRPLRRPARVRRARRPAVQAGNVGVPLRCTGARGAQRRGPGHRLYRRHPVPLRLRCRRAAQGGGRLALQPGDRGAGGRQGLADPFGGRPQGQAHCRQSRRLGAFPRPWRVASRRPRTAGRKLFLPWSGGRPRRPGAWLGRRLGALGALYLQRRAARSGAGHRQRCRDHDRLLLCPGQRRCDRPQEGRDQRPADPPGACPGLGPEAPGGVRRGPGQGSEHAARSHSALGWRGAHQSCGLRSGGCRHPADRRRFLPCRRRAAEVAGGRPGVRLQPVRRCRRSGPPVARRPPRRPALRSYGMRQTLSLFLLLCLLVGQACADERVTLRLADQKGNMRAQLEAAGALDDLTYDIRWFEFPAAAPLAEALNAGAVDAGIIGDAPLLFALAAGARLKAIAVDKSDPYGTAVLVRGDSPLRSANDLKGQRIATGRGSIGHFVALKALASVGLGEKDVEFRFLGPVDAKMALANGSVDAWATWEPYTAFAETADKARVLVDGRGLWAGNSFLAATDSALADPAKRAVLQDYLQRLASAQRWAYLHLDEYSRSLAQIIGFPEDAARLQFERRRLRWQALDERTLGQQQETADFYQAHGLIPQRLDVRPTFASGFAVRQASDADIR

SEQ ID NO: 31333 - protein, 358 aa, Pseudomonas aeruginosa
LITISYLSIVFYSNNLSVPSPAAGTPVPAGARTYPRSHRMSRPFLRRLAIVFAASVVLSGIGGAQAEEVLRIGFQKSSTLLTLIRSQGTFERELARQGIRVSWHEFPSGLPLLESLNVGNVDLSADVADTVPVFAQAAGARLTYFARETPSPAAQAILVGEHSPLKSLAELKGKRIAVTKAAGSHYLLIAALASAGLEFSDIQPAYLTPADGRAAFENGKVDAWVTWDPYVASAQRQQRARVLADGQGLASYQRYYLASSDYARKHPEVLQQVFAELQRTGRWLKSHPADAAKVLGPLWGNLDAATVEQANARRSYDVQPVSADGLDEQQRIADAFHAQGLLPKPVDARAVEVWQPRH

SEQ ID NO: 31334 - protein, 573 aa, Pseudomonas aeruginosa
GYAKFILPDAEKAGVGLHSWANSIQDDSTMPDVRLSSRSLTPVLCAVGLACALQGEVQAADGGPRDAATAPRVFDIAPGELAEVLLNIVRQGHVPIAFDQRLVAGLRGPDIRGRLSVEDALRRALAGSGLAYAQDESGAFVLRRGQAPVQETRGAAVAPTLSTVVVTGTRKSDVKAQDSLSPIDVVSATQLRSSGAVDLRDALVKLLPSLTRQAQPFNASALTHTQSLRGLSPNHVLVLVNGKRRHETANLNISGGLEKGSTGVDLDTIPINAIERVEVLRDGASAQYGSDAIAGVINVILKSADSGGSAAADVGQTGDGDGFTHGGGGNIGLAFGDSGFVNLTAEYREQERTMRSGIDERTGRRDNISMGDPAFHRQSLALNSGFGLGDDIEVYGFGTYTRRKASSAANYRLASVAPTLYPDGFTPRPNSDEDDYAFLAGVHGERLLDAWHWDLSSGYGADRPDIGMTQSVNAAIYRETGNSPRSFDLARYRNSQWTSNLDLGREFELDFLAAPPGVVAGVRNTGGKATASTPANRRPTTAAGRNPWLASRRSARGNGRGTPGRPTWTWVPP

SEQ ID NO: 31335 - protein, 133 aa, Pseudomonas aeruginosa
TSTPTRSASATASSTAPPIPARKPSMPWPRRGSRCRPVPVRSVPITWPTVPTPAPAVSTSPVTTSSRLASTGRSTGNCRPTSTAPPCARTIEAPTASRCSMPSRSPGSPAPPRAARFPSAAPGAARTGRSACA

SEQ ID NO: 31336 - protein, 550 aa, Pseudomonas aeruginosa
PPAPTTCSTSVRTSCPRRTPPMATCCATTPMPRRSASTAPSTTYARHTASRGPGVAQREFSATSGGVLLASVVAIMLGPTGILLNTFSLFIAPMSAEYAWDRAEVSLLVTLFGLAVAITSPLKGWLIDRWGARRTMLGLTAALSLPLLGLAAVNAVWQLYALFLLIGLLAPGNLPYGRILGLWFRQRLGVAYGLLGLGFGVGGPLGLLVGHQSLEAWGWRGAFLVYGVLELGLALPLLAWLFREPAPDAGVAAGTAVAETALSGSTAPQAWRSASFWLVLGNPGTGGVRDVRDHDPWRADAGGARFVPGRGGHRAVGVVGRHDAVAAADGLASRPRGDASGGVALRPGGGARHGLVPGGRHTERSMAGGVPGRPGWRRGKRHHQVPVDALLRPAQLRCDLRFDPAVHLRPVDQSRRLPAGLAVRPRRRLRDGRMGAARGFFPGCVQPVRLSPLSAEIALKGIMPASVRPGAARSCRRGGPGDSRWRTVPSSDGRRGENWRYPCSPASRRLPRCAVARPAAVGAPCRGGPGRALPGSWCPRRRAVGAASVR

SEQ ID NO: 31337 - protein, 470 aa, Pseudomonas aeruginosa
RRGGRRLAGISGHACRARASLAFPARRTPGGLEDRKSERRGVGEQGQLDLLIGSVGCPGRLGWTFSSSRAGLSRPREVATDAAAKEQRMTVLIQGAGIAGLALAREFTKAGIDWLLVERASEIRPIGTGITLASNALTALSSTLDLDRLFRRGMPLAGINVYAHDGSMLMSMPSSLGGSSRGGLALQRHELHAALLEGLDESRIRVGVSIVQILDGLDHERVTLSDGTVHDCSLVVGADGIRSSVRRYVWPEATLRHSGETCWRLVVPHRLEDAELAGEVWGHGKRLGFIQISPREMYVYATLKVRREEPEDEEGFVTPQRLAAHYADFDGIGASIARLIPSATTLVHNDLEELAGASWCRGRVVLIGDAAHAMTPNLGQGAAMALEDAFLLARLWCLAPRAETLILFQQQREARIEFIRKQSWIVGRLGQWESPWSVWLRNTLVRLVPNASRRRLHQRLFTGVGEMAAQ

SEQ ID NO: 31338 - protein, 1014 aa, Pseudomonas aeruginosa
GGCQSECRQAWVPGKSIHLPANMAASLPMYPQAPGRGCAAFCPAGELCHRRLDMLTRSLLSAVFCLLLIALQPLPVEAESILPDGRTTTTMRPWLDKRARQWLDAREPLTVGVVSPDYPPLSIFYAGSYKGFTADYLALVFERPLRVRDFPSRQAAIDALSQGEIDLLGVGSEVEARQHGLLASAAYLSDRPVLVSSSGAPFDSQAESWLATVKGYLPAERIKAAYPHSRIIWFDSPQLALEALSMGDVDGVLGDAVSTHYLIQTHYLLNLRIENFAPIDSQGFRFLLRPGDEPLLALIDRALPHISGRYGDELLRSWSAGRRLRFDEPRVTLSPAEQRWLSAHPVVPVVINHSLGALGQLDNEGRLSGIGRDYLDLIGKRSGLQFSFTGARNFVETKSRLDAGEALVTPTMPSSERFDSGLEVLTPYLRSTTVLMGARQGGRDERVGRVHGLADLAGKRLATTIGYFLNDFIRREHPEIKLQVYPTFLAAMRSVDAGQSEAAISSDYTGRYLSAQHFDNRIQVVGILDDLSIPISIGVARNQPELQGILEKAQLAIAPEEVAEILHRWEPRFAKGGADFWRDHRSKILQIGGLFGVLISISLIWGFYLMRQVRKTRQAEEQADAANRAKSVFLSTMSHEIRTPLNAVIGLQELVLKKGEKGVLDLDSLSIAQEAAQGLLLLLGNILDLSRIESGRFDSAPESVLPGELIRGILPLVGGLTRQKNLSLALELDGDLEHWVLVDPLHFKQVLFNLLGNAIKFTERGGVTVRAVGRREAERLHLLLEVSDTGLGISEEDQARLFRPFSQVGSPALGQASGSGLGLYISRRLVHLMGGQISLRSELGNGSCFSVEFDLPLTEPPPSESSEARSGVAEVEERKEARALSILLAEDHPFNRLTLTMQLESLGHRVTSTEDGEEAFERWQGEDFDVVITDGMMPRMDGYELARRIRSQEALGGRRRCLVIALTASAEKDALERCLAAGMDRVLFKPTTLDELARALNGGEPLMPTSVDSQ

SEQ ID NO: 31339 - protein, 207 aa, Pseudomonas aeruginosa
KCPTGCRFACRERMYRVISRRNEPALVKRTMGFEQLAELRDRLRAQAAQAKPAQTKSSAGRAKKREAVEPGVEAIWRLQRHFPLAFPKSPAAKVPLKQGILQDAQQHLELLGITAEQLKQAIATWCQGSRYWSCMVEDAPRLDLQGQVAGKVTAEQAVYARRQASRRQREQMREKRAKRAQAGGEAPAATEAPTPEAPATEASPEAN

SEQ ID NO: 31340 - protein, 110 aa, Pseudomonas aeruginosa
SPGQGASDPGALLGCRSLRAHFADVWARFSRLVLRNSLICKVFFVERLPSSANPSIIASIPAMGELKIFLNQRVISSKSRQERDFSDMPNACRFAQRLSSRVVMHRIANP

SEQ ID NO: 31341 - protein, 322 aa, Pseudomonas aeruginosa
RRPGLHPCDELRRLPEAGQGSGRPVPAFARPQRNAVHHPAPDLGAMDEADAPRTAGRPGARQVRQARSGAENARQGFADLRPTGTRLGGAGHHDADRVQHHPPVPGPVFRFPVLPVPRDRIHPRQQERHPAQAPCSPCRAAGGPGAGPAYAVAIRRSDPPDGRPGVAGKPGAARPGRGGRHLLRGLGGGGVATGLPGAGTLLGPVSAGGETDRPGGLVPPVALPSRDHGGAHHRFQTRHGRNRGSGVSAQHARYHPLPRTVAAPFQPVVPDEVQHPPAPQSLPAPPAAHSCRKSPMRTTFQRSRPTRVAERRKPSSRNPARR

SEQ ID NO: 31342 - protein, 597 aa, Pseudomonas aeruginosa
SGVGRCRRSCRPRKFFFKIALIKKVVTGFCLSNAMEGWKTTLDNHRPVLRESAHERSDPSRYAGNDFGHADLRHHWLAGAALRAARAGRGVLALRIRFRHAAGRLCRAGLPAPRQPGARGVPAGAPQRGVHRRQLGVAVRILLTGFDRHRYRGLQRPAVHAGGARRGVSRREGHGAQAGLAGAFVRRHAGDRQRPRRQRRPARGLPVRYPPGARCRAAVCLCRADREAPARHAAASYRLDPGGHRRADARTAGEPCRTAPGRCSLGQPGDPGNRPYRADVRTALRRHSEIADGADRCLVLHLSGRGDPGGLAGLRTSPEPGPVAWRGCHPARRGGHAAGLERAPAEAGGASRLRRGGKKKPRDEAGLFYGDLGRSVAEDLEAFAFGDEGFLARRSGDGAERHLCAQLPAFRQVPGLVGLRIYQRVVVLQAGADLVLGEGGPDRELGHAAGLLRPHREVVGVEGELLLKLAHYRLVFEEQYGAGTGGEGIELGFGGGESVGGNDLLQLVLGDVPELLVLGAEQDDHPRALRVERGRAVRDGLLDQFDDFLLGDGQLLVQGVDGAAVLDGGEECVRHREAPCLEIGFDISDGLDEINGK

SEQ ID NO: 31343 - protein, 250 aa, Pseudomonas aeruginosa
LSLAISRHGKEPRDEHSAENPRFGRHRHRGCGAARRGRLLGAIAVGQGAVGERAERQCAAQPHGRRHDARRLARRRPGGVRGPARRRRGGRAGPPGPAGAQPVVSQGGRAEPGAASQRRHPPGAGRVAARPGSLHRRRREHRRQGVARSRGGTGRAAAVRPGLQGAGRAQRSAQQPDRETRRADQPGARRQHALFRLDARGRHPGRLPGPRAALSPVAARRPQASAQAGRLGPGDRPGQPAGADRCRQRR

SEQ ID NO: 31344 - protein, 157 aa, Pseudomonas aeruginosa
AVLPRCCALLTGKDRESGFFASFVYEQEFIYRRSIMAWKGEVLANNEAGQVTSIIYNPGDVITIVAAGWASYGPTQKWGPQGDREHPDQGLICHDAFCGALVMKIGNSGTIPVNTGLFRWVAPNNVQGAITLIYNDVPGTYGNNSGSFSVNIGKDQS

SEQ ID NO: 31345 - protein, 333 aa, Pseudomonas aeruginosa
PFTRSIWSGPCSPVPERRAEAGEHAGTAHSTCLRWLTPQPVLQLLRQHRLGDQIALALVAAPGLQQVEGVVGLDAFRDHPITQLAGQADHRLGDALRLRRAGEVAGERLVELDGGDWQIAQVGPVAVAGAEVVHRDAHAKLPGTQQHRADRRGVADEYAFGEFQLEGGKVDVVGFGESDGLFQEAAVFHVRCRYVDRQPERDVPCVPLRQLGHGMAQHPVAEGAHQCGFLRQGHEFGGADEAELRVPPAQQRFHARAPACRQVDFRLIHQMEAFFGSDRLGQRGQQCEGTLLGLVQRRVVAGPADTAVAGVVGRADHQAQPVLIAVEGIVGKR

SEQ ID NO: 31346 - protein, 166 aa, Pseudomonas aeruginosa
PASICSTPQSRVAASRYCRPWSFTRLTISSAMAPVAAEIIPGRPPAKAITTAMLKEAYRPIFGSTPAMMEKAMASGISARATTRPASRSPRRLENQFCFSVCSIGIPRGEARPVQSVDSAGRGMALEKTRDDDRRSGERTLATVVRTVAGRGRHGYGGVGSQVIGE

SEQ ID NO: 31347 - protein, 183 aa, Pseudomonas aeruginosa
GNAMRSKASGLALVVVAGLVAGCASSGYQPEVDWPAGWQVITESIPPEASDVEQLGSRQLATKLGPGGEKEASIELLSLKMMEEESVEIDGQFQSVFDVVQSGYRKAGLGSRCTTPIRSNLGGLASLETHCRISQGNEVLLTQIVAMALGQRAMYSLVYTASPANSVVYRQSYLRTRASLVLR

SEQ ID NO: 31348 - protein, 415 aa, Pseudomonas aeruginosa
PLPARSRSSACARSASKRFACSRCARGAIERMEPRPAPALRWRAARSEARGAGEERRRDSGEYQGHHLGAPGRRSAGGVAPAGRRAGGGPPGRRYRSAAARQTLRAGHLARLFAALAGSRSAHGRRVLRHGLAAPEEWQLRFHEPLRDPRADPGAGADRHPAIPLPAVRRLPAAPAAPRRPGGNRPRRGAGPVRASAVLLHPMDDHPWPGLLAGRPAHPDPGHRPALSAAGLHRGLPGDVQRQPAFLPSPQPPAVQCRLPGLAGPPRQAGAAALPARRAGQHPGPLSRSAEPGGADQGLPAQPAAGTLAGRGRARRAFLHGALDPAPQAVPGRAELPGAEGPGPPRPGHRAAGRRRGEFRRTGAGAGLRRWQRVPQGVQEVDRLDPRAVPDAGRGGNRVGRVVRRLVRNARPSIG

SEQ ID NO: 31349 - protein, 362 aa, Pseudomonas aeruginosa
  UNSURE (39): Identity of amino acid at the above locations are unknown.
CSPPAPPAWPNRCRCRFRRSPPSSVTCARRWTCAQRTQXWNLANPGWPYGLLTTLSPVPSPWAIGPPSTKGRSAWKAPAGSSVDYGITNLAGSPTAYRLLMAAGAAAETALKGRMRAVSSAGEPLTPEVIRWFADRLGTTIHDHYGQTELGMVLCNHHALAHPVRVGAAGFACPGHRVVVLDDDLNELPPGQPGILALDRRRSPLMWFPGYQGLETAAFVGDYYLSGDTVELNEDGSISFVGRADDVITTSGYRVGPFDVESALIEHPAVMEAAVIGKPDPERTELVKAFVVLCAGHRPTPELADALQRYVRQRLSAHAYPREIEFLEELPKTPSGKIQRFLLRNQEIARQREAAPRAAAAN

SEQ ID NO: 31350 - protein, 664 aa, Pseudomonas aeruginosa
FSRRKRRAYRKSSVPGYRRQLRPRRRHREDAGGAGWQGGAGRHQRRGRRGQCRRAWRPGALRQGRHRQRGRRPPGRGRCTGGLRRPPWPGQLRGRGAGREGPRTQWHPCPGEFPPGHRHQPGGQFQHAAPGRRGHVPGPAGRGRRARGDRQYRLGGGVRRADRPGRLFRLEERGGRHDPAHRPRAGALRHPGDDHRPGHLRDTDDGRHAPGGARLPRRQRAVPAAPGASGRIRRAGPADHREQHAQRRSDSPRRRHPHGRPLIQEEDPMTREDPIVIVSAVRTPMGGFLGDFKDVNAATLGAAAVRAAVERARLQADEVDEAVLGCVLAAGQGQAPARQAVLGAGLARGTPCSTLNKMCGSGMKALMLAHDTLLAGSAGVALAGGMESMSNAPYLLERARSGYRMGHGKVLDHMFLDGLEDAYDKGRLMGTFAEDCAEAYGFTREAQDEFAVASLTRAQQAMRDGRFQAEIVPLTVTVGKTERLVDSDEQPPKARLDKIPTLKPAFREGGTVTAANSSSISDGAAALVLMRLSEAERRGLAPLAAIRGHASFADAPNLFPTAPVGAVKRLMQRTGWSLGEVDLFEVNEAFAVVGMAAMRDLDLSHERLNVHGGACALGHPIGASGARIVVTLLNALQQYDLERGVAAVCIGGGEATAIAVERLR

SEQ ID NO: 31351 - protein, 409 aa, Pseudomonas aeruginosa
AGNLRQADHRAPGGGLPPGRHGHPHRRGAADGPPRRQPARSRPAVPDRSLDGQAVRLGDGRGSLLRGDPDPRWLWLPQGLPGGTHLSGRAGLPDLRGHQRRAAPGDRAQPVAATIRRFRNGAFSLQGEGALRHLGSKCPSLVRPTPLGRRSRRLRRLVLARGDLLAQLDDLLAHPAVGRVLIGALVPVQVGFQLRHVAHRQHRVVQVVVTGEAFRHGHRHVGLLDHRGGHQVVLRAQRDLALDAHLAQRQVDVAEAAAAAGNMDVGQAQVIVQGQLRLARQWVAAAHGADVAVLHQLDVAHLGIGVQRRVDGEVEAAGGEFLGGLAALGEEALDMHVRRQAAQALEQRGEDDRFGEVGHADAVGLVRLLRIEAAALLHRNPQQLQRVAHRADDVLRHRGRHHALGGAHE

SEQ ID NO: 31352 - protein, 383 aa, Pseudomonas aeruginosa
STGRSRCTVAPGFPTTSRWLTGTPCSAPCAWPTARTRCTARRSASSSWASTCPGRCCAAAADGCGIGERPAGAGLFHSGDSAPFSSALRSSCHARRLCSRAANSRAARSLRKQIPRVPRRTRQKGSAWVSRRSIQSVFGIRFGLVLDGGFRRAGLQQGEQDAARQQAEGYAKREAGGNLADHTVEHDLRTDEHQHQGQGVFQVDEAVDHRRQREVQGAQAEDGEDVRGVDDERVLGDGEDRRHAVHREHQVGQLDQHQGEEQRGGVAHQLAAGVRQADEEVMLVQFLGHPHVLAQETQHRVVLEVGFFLVLVEQHLHAAEQQEGAEHVHDPVELLHQRGAQADHDRPQDDGAEDAPEQHLVLVAAGDAEETEDHRHDEHVVHR

SEQ ID NO: 31353 - protein, 336 aa, Pseudomonas aeruginosa
VRRVTLRLQRWGIMALRHCLGQEVEKHPGLAGQLARWIDRVDRRLVGLPVSQQFNQAAFGQFRLYVQPWDQAQAEAGEQGIAHRQAGGHPVTAGDRHRYALAVLAEGPAVGMAREAEADALVFAQGLRPQRLAMLTEVGRRRAEHVLQDQQRAGDQAGVRNPVATTQGQVDAFGDQVLAAVLQEQFQAQVRITLEKSRNGRGQAGEGEGQRGADPQQAAGALLHRSERGVGGLEVVEDALQALPVDFAGLGQAHAAGGAIDQAHLEVRFQLGDVLAHGGRREIHLPGRGGEAAIRGHGAEDLEGGEVIHGDNSLSVINESGIKPLSTRGVLAKVLP

SEQ ID NO: 31354 - protein, 382 aa, Pseudomonas aeruginosa
ASGQFQPDRGVIGGLLHAAQVVVDAGVLEARLQHPAGQDHIDAQAALGVVLEATAAVVEPAEAVVHLRIQGPEAVDQAPVLQRSQPFALFRQEAALAGLQPALAVFLANADVAVLRRDIDVAHHHQGLLGLEAVLQQRLEIGVEALLGRELGRMLAVLALREVTVHHGDRVALGVAEGAPDEAPLGFLAVAREAAMQFQGRLAGEQGDAVVAFLPVVVDVVAERLDLGLGKLVVGDLGFLQPDHVGLVPLDQRRQLVRPGAQTVDIERDDFHGGRPGKTGMLAQPGDAWRPWRRCASVRRVPDGCVAWRLAGPVVCRGRGWPGHPLDQSPWRSVRVAAPSADKECVPCLIRSPMSVCSTTAIAAKSARFSTTPTATNRPSPT

SEQ ID NO: 31355 - protein, 605 aa, Pseudomonas aeruginosa
NPNVRRWSAASAQIWTRATRLRSIRAMRLTQGLFRFPLAGLLCLSTAAFAESQLSVRVTPANAALKANIEAYVGSLGERDEAALQRFRRNAEAQAEKAAQALGYFQAQIDSEVKDGKPPKLTLKVVPGEPVRLRQVNIQVLGEAASLESFRLPSGKQLKAGAKLNQGVYEDAKRLIQNQASRYGFFQGRFSTQRLSIDPRAGIADIDLVYDSGQRYTFGKVSFDGDSIIEEELLRRMVPFKAGQPYDSELIAELNQNLQSSGYFEGVRVDAAPTQAQADGARQAIPVAVRLEARKPRTMGVGLGFSTDVGARARFNWTRHWVNAEGHSLGFESEISAPRQNVGAWYEIPLDPPLTDKLRFTSGYQFEDLVDTESKLLTLGGEWHSKQPDGWQRVVSLNWMREEYKLGDDSGLSSFLMPGIGYSLLETDNKVDPSHGYRLQFNVKGAKEGLLADADVLHVDAMAKGLTSFAGGHRLLGRLQVGGIATNDYKSIPPSLRFFAGGDQSVRGYDYRTLSPENSDGDKIGGRYMIAGSVEYQYPLAERWRLATFVDQGNAFNSLDFPSIKTGVGFGVRWVSPVGPLRLDLAHALDDDGGFRLHFSMGPEL

SEQ ID NO: 31356 - protein, 588 aa, Pseudomonas aeruginosa
RQRPDRKQGPRRHRPLRQGRRLRSRRPGGAATEAEPRGGFRALRAVRRQPHGRRLPRRPRRGAGGGRLPGLHRTALAPAAGTDRPRADQPPPGPGLGDAAPDPGGNGPAGGRRRLPQDHPAGRPVGHLQRIAGAEGRPLMAPREPGVLKRAVLWLLFLGPFFFASYGLANWLTSQRGDVGSLVFDWERGMPLWPWTILPYWSIDLLYGLSLLLPRDKRELDTHCLRLLSAQVLSVTCFLLFPLRFTFERPELGGVFGWLFDVLMGFDKPYNQAPSLHIALLVVLWVCYARYASGAWRWLLHGWFALIGLSVLTTWQHHFIDVPTGALAGWLCVWLWPQAQPAPFARASLSRDRQRRRLAARYGLGALACAAVAFAVGGAALWLCWPALALALVALNYLLFGAAGFQKGSTGRLSVAARWLLAPYLLAARINAWLWTRRRPQPDEVLPGLWLGRLPSSAELADSRFRALLDATAELSCEPQGLAYRSLPLLDLVAPDVEDCRRAAVLIDELLAQGPLLVACALGYSRSATLVAAWLLLSGRAADVESAVAVLRRARPQVLLGEAQRRTLAALSGSVPEPSAELGEVRHA

SEQ ID NO: 31357 - protein, 344 aa, Pseudomonas aeruginosa
PAVRRTDPAGHRAGPVPGRARHRLALFRCGDAGDRPARPVAEVLGAASGPGRRTVRTFQPRRRQAGSADPRPGPGPGRSRPGPTGRRRAHLEPAQPRRPAPATLAGAGLWRPVPAGLVVPVVDPSIQRSNLKSLPMLESVVAYGIIAGARAITGLRSLWLGTTPIPKQRIYYANHSSHGDFVLLWASLPPEVRRRTRPVAGADYWNKAGLRSYVINKVFNGVLVDRQRSEVNANPLEPLDRALDGGDSLIIFPEGTRNLDDEVKLLPFKSGIYHLSLAHPDVELVPVWLANLNRVMPKGRMLPLPLLCTLSFGKPLVATAEEGKEAFLERARMALLDLAPEEEA

SEQ ID NO: 31358 - protein, 384 aa, Pseudomonas aeruginosa
FALQPGSGIRGRDRSFTVSEIDQAHAFLAIATAGDRLGGEDRIQLGQFRRAQAQFRRGDVLLQVAPLFGAGNRDQVIALRQHPGQRQLRGFHALGCGQFADLVHQLQVLREVLALEARAETTVVVGGEVFRTLQGAGKETSAQRAVGDEGDAQATAGGEHPGVLRIAGPQRVLALQRADRVHPVGTLEGFRRGFAETDVADLAGLHQVGEGADAVLDGYLRVHAVLIVQVQAVGTEALQAAFDGAADVRRAAVDAARPGIGRVADDAELAGQEHLLAFAAQGLAEQFLVTVRAVHVGGIEEVQPEFHGAMQGGDGLLAVAAGGVEVGHAHAAEANGGDGRAVVAELTGFHVSSLAGGKENVVILRSALVWIKPIITVLPFVFSK

SEQ ID NO: 31359 - protein, 257 aa, Pseudomonas aeruginosa
SRVSDGSFPGHAGLHPHRRAGRLRQGRGQPGAAARQRDPGDPATGGAPWRAVAAAHHPPGKPDPRRAGLLRALRAPAGGPGGGGKLLSTRPEQPARALAGRPAGRTGADAGDSVPAGVLRALPGTGAAVEQQRSPGRPAARGRGLRAAGRRTARFQPGRPAPGRPAAGHLRQRRLPGASWPSAAARRARRAPRGELPVAFQRAYLRLRVQRRRASAHVADAQPGQRQQRRCLRRRLPGRARADPGAALSRRRRPGRR

SEQ ID NO: 31360 - protein, 452 aa, Pseudomonas aeruginosa
GSLMESLQKWVVDLNGVVWGPLMLVLILGTGLYLMLGLKFMPLVRLGVGFRLLWQGRSKDDESSGEISPFQALMTCLAATVGTGNIAGVATAIFLGGPGALFWMWCTALVGMATKFSEVVLAVHYREKDERNEHVGGPMYAIKNGLGKRWAWLGAAFALFGGLAGFGIGNMVQVNSMADALEVSFGVPDWVTGVATMLVTGLVILGGIRRIGKVAEALVPFMCVGYIVASVIVLVVHAEAIPGAFQLIFTHAFTPIAATGGFAGAAVMAAIRFGVARGIFSNEAGLGTAGIAQAAGTTHSAVRSGLIGMLGTFIDTLIICSLTGLAIITSGVWTSGASGAALSSAAFEAAMPGVGHYILSLALVVFAYTTILGWSYYGERCWEYLAGTRAILPFRIVWTLAIPFGAMTQLDFAWLVADTLNALMAIPNLIALLLLSPVVFRLTREYFAKARS

SEQ ID NO: 31361 - protein, 1000 aa, Pseudomonas aeruginosa
RPASRWWWKAPTACATVWKCVSPRPPRRSSRASRRNRRLAAPAASRATRWVAGALNEPVPPVHPAAGRDHPADGGDPALGPDRLPLPADLGVAGSGLPDHPGGHPVPRRQPGDHDLVDHRAAGEPARADSGAQRDVFQQFRRRLGDHPAIQPAEQPRCRRAGSPGGDQRRAEPAAQRPAEPAGVQQGESGGRTDPDPGGDVRRHAAAADPGPGGYPPGTEDLADLRGRPGQHQRRPAPGGAGARQPDGAGGGGAEPGGPAQHGDQQQPQRPQGQLRRPDPCLDPGRQRPVALGRRLPRPDHRLQERLAAAHPRRRQRRGRRRERAPGRLGQQPAGGGAEHPAPAGGQRDRGGRSDQGAAAAAAIDPAGQSRRAGADRPHHHHPRLGQGRAVRAGAGGGAGGDGHLPVPAQRLRHPDSQLRRAAVADRYLRRDVPVRLLDQQPDPDGADHRHRLRGRRRDRHGGEHRPLPGAGRLAAGSGAQGLEADRLHHHLADLLADRRADPAAVHGRRRRAAVPRVRHHPGGGDPDFRLRLPDPYADAQRQAAAPHRRGPAGPLRARRGAGHRWPDRTIRQGPAGGPAAPAADPAGGHRHPGADRAALPGHAQGLLPGAGHRGDPGRRRSAAVDLLPGHVRAPARPCRGGAEGPGGGQPVLLHRRRRQQPDPQHRPPADQPQAAQRARRHRQRSDPAPAARTRPPARDQAVHAAGAGPDHRGPGRPHPVPVHLAGRRPGRARRVGAEAGGAAAGVAAARRRRQRLAGQGLAGLPEHRPRHRLAPRREALRHRQRALQRLRPAADLDHLHPGHPVPRGAGGGAAVPARPAGPGAALRAVQRRHPGAPVEPGEGGGAAYPAGDQPYRPVPLGDPVVQPGQGLLPGRGGRGDPWRRGQPGAAAEHAGQLPRRGAGLRGLAVEHAAADPRLGGDHVHRPGHPLRELHPSGDHPLDPALGRGRRAAGADAGGAGDRHRGDHRHHPADRHRQEERDHDDRLRPRRRAQRRQAAP

SEQ ID NO: 31362 - protein, 1133 aa, Pseudomonas aeruginosa
GDLPGLPAALPADPDDHHGRAARRAAADARRRRRRRAAPAAGHHHGRWPAAEPGPDPVHHPGDLSLLRPPGPSLGGLAQAARAGPEHRGRVRRGRRAMSLSTPFIRRPVATTLLTLALLLAGTLSFGLLPVAPLPNVDFPAIVVSASLPGASPETMASSVATPLERSLGRIAGISEMTSSSSLGSTTVVLVFDLEKDIDGAAREVQAAINGAMSLLPSGMPNNPSYRKANPSDMPIMVLTLTSETQSRGEMYDLASTVLAPKLSQVQGVGQVSIGGSSLPAVRVDLNPDAMSQYGLSLDSVRTAIAAANSNGPKGAVEKDDKHWQVDANDQLRKAREYEPLVIHYNADNGAAVRLGDVAKVSDSVEDVRNAGFSDDLPAVLLIVTRQPGANIIEATDAIHAQLPVLQELLGPQVKLNVMDDRSPSIRASLEEAELTLLISVALVILVVFLFLRNGRATLIPSLAVPVSLIGTFAVMYLCDFSLNNLSLMALIIATGFVVDDAIVVVENIARRIEEGDPPIQAAITGARQVGFTVLSMTLSLVAVFIPLLLMGGLTGRLFREFAVTLSAAILVSLVVSLTLTPMLCARILRPLKRPEGASQARRSDRFFAAFMLRYRASLGWALEHSRLMVVIMLACIAMNLWLFVVVPKGFLPQQDSGRLRGYAVADQSISFQSLSAKMGEYRKILSSDPAVENVVGFIGGGRWQSSNTGSFFVTLKPIGERDPVEKVLTRLRERIAKVPGAALYLNAGQDVRLGGRDSNAQYEFTLRSDDLTLLREWAPKVEAAMRKLPQLVDVNSDSQDKGVQTRLVIDRDRAATLGINVGMVDAVLNDSFGQRQVSTIFNPLNQYRVVMEVDQQYQQSPEILRQVQVIGNDGQRVPLSAFSHYEPSRAPLEVNHQGQFAATTLSFNLAPGAQIGPTREAIMQALEPLHIPVDVQTSFEGNAGAVQDTQNQMPWLILLALLAVYIVLGILYESYVHPLTILSTLPSAGVGALLALILCRSELSLIALIGIILLIGIVKKNAIMMIDFALEAERNHGLSPREAILEACMMRFRPIMMTTLAALLGALPLIFGIGGDAALRRPLGITIVGGLIGSQLLTLYTTPVVYLYLDRLRHWVNQKRGVRTDGALETPL

SEQ ID NO: 31363 - protein, 153 aa, Pseudomonas aeruginosa
SRQWAAAGTAPISSGPTSGSAGSRRACRLRPEFFSLPVPDECLSPLLRLHDTPPSASRLECGGGCGGEYVSGKFPEMPSRRGYWLGWLCRLAMLGGVAAMFWALLQCFVLLHGEPPLQRAPLRTPWTLLALGLALFLAGFCGEYRLWRRRAGC

SEQ ID NO: 31364 - protein, 200 aa, Pseudomonas aeruginosa
KRSNRCGRYSGGMPGPSLLTLTSVCPARSPIRTSMRPPCGVWRTALDTRLEMARWIIRLSPWAKPLPDRRSSTPLSSATISYRSMTLAACSCRATQPNWAWIAGLSTCTRNSMSVTIRDSRSSSSALDSRASRYAAPSRCWLSSTWLRTSRLQIGARSSWARSSENCESWRTPSSRRPSMWLKLRARLSSSRGRFCSGMR

SEQ ID NO: 31365 - protein, 483 aa, Pseudomonas aeruginosa
FFRHLADKPRYLTSAASRKCNFEYRRRDIADERLRGSGPVMDRRRRRRSADEERNMPILRPLASAGKRACWLLMGLCLGLPALANEAPVSFNGTSISLEQALERALRSNPELAAVGRETEIASGARQQAGLIPNPDLSWSVEDTRQGNRQTSVSIAQPLELGGKRGARVEVAKRGSEIAWTQLEVRRAELRAQVRGAYYAALTAQERVRLAKTSLDLARRALQAADRRVKAGSISSVERVRAQVLADNAQLDLSQAELEQQRTYVQLSSTWDEPQPGFARVGGALDAVPASITRGALLRHLDESPTLRLAAQEVARGEAQVDLEKRQRIPNLTVSIGSKYDQTARDGRGERVNLIGLSMPLPLFDRNQGNIYAAQSRADQARDLQRATLLRLRSEAVQAYDQLRTSEQELALVRRDLLPGAQSALDSMTRGFEMGKFNFLDVLDAQRTLVGVRAQYVRALDAAAQARVSMERLLGEDIGHLGQ

SEQ ID NO: 31366 - protein, 376 aa, Pseudomonas aeruginosa
DFRGGPPARPPNGSGEQNGQEDDYRGDRTGTARPGRRRLPGAGREGAGRRRRSGRRGRGQRTARRHVVAPGRPDPGTAGAGGRQPAQGLGRARRQGAGAAGGGPRRRRRACHRRGRGPAVQGQRRWPGGQCRDRRAACLHRAPQADGRQAGLRLRLHPRGGQAGAGCRADRGRRHHPRYGADDQPGPGGLAARRDPLQRGPHRAYRPAPAGDRRQRAGQSWPGGEAGRAAGGDQQPAVVRPAQRIRRRPAPPEPGAEHLQARAAAVEGGHFRRAGIPARPPGFAGSRDRAEQRAGEDRRARRQSQPAGRQPLRAARAVRRGAGGKAPDPGRAGGRHRQRLHPVRPVLGLGHLQRARATARPGPRRQQGQGARPGAG

SEQ ID NO: 31367 - protein, 463 aa, Pseudomonas aeruginosa
TITTEAPAMSLGSDYLRSLLEEDPERGVYRCKREMFTDPRLFELEMKHIFEGNWVYLAHESQVAGVNDYLTTQIGRQSIVIARNRDGQLNAFINACSHRGAMLCRHKSGNRSSYTCPFHGWTFNNSGKLLKVKDPAEAGYPQGFNCEGSHDLTRVARFESYRGFLFGSLNPDVRPLAEHLGESAKIIDMIVDQSPEGLEVLRGSSSYVYEGNWKLTAENGADGYHVSSVHWNYAATQSQRQQRDAADPLRTMSAAGWARQGGGFYSFEHGHMLLWSRWANPEDRPAFERRAELARDFGEARADWMIENSRNLCLYPNVYLMDQFSSQIRIARPLSVDRTEITIYCIAPKGESAEARARRIRQYEDFFNVSGMATPDDLEEFRSCQQGYQGSVVGWNDLSRGAEHWIEGADAAAAAIDLRPRLSGVRTEDEGLFVLQHRYWQEALLAALERERTQRVALREVAS

SEQ ID NO: 31368 - protein, 314 aa, Pseudomonas aeruginosa
PSTSPRSTCTRATSTSTCAGRRRWSRRSSATCASRACARRISTTKSSPPARPEPERAKEIPMNDRFRDKVALVSGAAQGIGLGVVRRLLEEGARVVAVDRSELVHELAGDACLCLTADLERYAECQRVLERTLERFGRLDILVNNVGGTLWAKPYQHYAEDEIEAELRRSLLPTLWCCRAALPAMLGQGSGAIVNVSSVATRGVNRVPYGAAKGGVNALTACLAFETADQGIRVNAVAPGGTDAPPRRIPRNAAAQSEEERRWYRQIVEQTLDSSLMKRYGSIDEQVAAILFLASDEASYITGVTLPVAGGDLG

SEQ ID NO: 31369 - protein, 146 aa, Pseudomonas aeruginosa
PRTSSSSRHATRISTCTCRVRRVSAWRSTRSAWRASAGAEAVPQTEEKRPMLFHVKMTVKLPVDMDPQQAERLKAEEKEMAQRLQREGSWRHLWRIAGHYANYSLFDLPSVEALHDTLTRLPLFPYMDIEIDGLCRHPSSIHADDR

SEQ ID NO: 31370 - protein, 137 aa, Pseudomonas aeruginosa
WPRPSPRRTPSGARKVSSRAARSTCCCATSTSTATSARANRARRAAATPRSGCRASWPTFPRASPRARWASASTPSPSSACAWTAAAGVPAPAVASTCCPMTTRGGRRTTIREPAARSSCAGMAPCCGSATCSRKPR

SEQ ID NO: 31371 - protein, 272 aa, Pseudomonas aeruginosa
SARRRRRRIAGRGAPYSGRRSRRAATGVRPGPHRGARRQSAGCPGAPRRPGRAAIWRPPGARGRGRPPAHRRVRARFRRSRSRHRAGVAAGRCRRLAQLRPGPVDAALARRPGCRRRGPAASRGCAGAAGLPGGPSAPCRAPQRPPGRPALPVARRPRRRRSRRRTGPVRRTAGGTARRRRRPGASPNPGAGVRPRPAAGRGSRRLPRHARGRVRRRRRAAPGTRSHRTAGRPACRSSRGLLLPRLPPPARARVRSSPRGRGSRRCPDRTVR

SEQ ID NO: 31372 - protein, 462 aa, Pseudomonas aeruginosa
KRTGGGGRRSRLPGHSRGARRNRCARGVAGLLESVRPGLRQDAGRVRRTPAVGRRTPRSRRTRPGDGPAGVGVRRGRVPFSVVLSIRGGHSSTARVRVPQRLGYHARLSIRPGRSPSNHAHLAATAQRRTGRRHAPGPVLRPARVPPGNLRAGRLPGGAQPQRQRPGQPAGRPRAAASSQGAVLFRQRLRRIAGGGGGLSGAEHGRLQVQPHRAGAGRGPAASAALADPHRQPDCHAARGTGSPAVAEADAGRQPPGGLAREHGRLRRPGTAADRRQPFPAPAGLAGDAAAPGLAGLRRQPVVPSAGAGRQRHRCAGLERAEPGRFDRRRSLRGHPSRRLAPAGRLDAHGGAEAVQGRSDQRWHPRQRDGRLPGGGAPCAIDRGARPARRASARARRAGAGAARRRLSQPGGAAEPGVLYPRRLSAGTALRAGHGAAPGGLARRVDGPSAWTRHQPWRLLCA

SEQ ID NO: 31373 - protein, 475 aa, Pseudomonas aeruginosa
SACWPSSATASISPPITEAPPAPAMAGAEVRRSVARLAHGPGIAGRGEAQGHQQHRHHARREQQPGGLEAAGDVAQPAGQVGHDAGDDEADALHEGRQASRRTRLVEVVEGQGQAEGEAGAQAVADQRHPQRRVLQRHQQQAAEAAELDQQRGQQPGPAVEAAANQQRHAERGEHLEDGHDPDQPAAVLGAPAELAVVHRQPGHHAGVAAVDQPEIHRQQPATAIAEEVPDRPLASARQHLPWPREHPQQQRQQGRYGPGAEAGLPVGEVFGDPRAEHRRGSAAGHQRGRVEAHRRRDPPREPALDHARYQRLDDRHAAAGQRGAGDQRQPAIQFQAPEAGCGDGQQSADDAAVLGQPAPEPGQQQRHQAHAEHRQHRQQRRALEAETGAGGDFLEQRADAGEDRSQVDAEAEDHQQADPTDLRRADAAGGLAARRDSRAHAWRCRHCRYRPSSPAGRRARSGRLCRCGGRAISA

SEQ ID NO: 31374 - protein, 160 aa, Pseudomonas aeruginosa
NTGVSSRPKKVTPIIPENTATPIAWRISAPAPVEITSGTTPMMKAMDVIRIGRRRRRQASSTAATRSMPSSCLSLANSTIRIAFLHASPTRTIRPIWVKMLLSLPARITPVIADSRVIGTIRITASGRLQLSYWAASTRKASSTQSGKTNSAVLPARICW

SEQ ID NO: 31375 - protein, 138 aa, Pseudomonas aeruginosa
NCPVRPEMNAVGMNTAQSTSAVAMIGPVTSRMARLVASTGLRPRPMLRSTFSTTTMASSTTMPMASTRPNSDSALSEKPSMCITAKVPISDTGTAASGMIEARQVCRNRITTSTTSTRASNRVCTTASMEPRTKMVGS

SEQ ID NO: 31376 - protein, 311 aa, Pseudomonas aeruginosa
PLETRNAMNRNDLRRVDLNLLIVFETLMHERSVTRAAEKLFLGQPAISAALSRLRTLFDDPLFVRTGRSMEPTARAQEIFAHLSPALDSISTAMSRASEFDPATSTAVFRIGLSDDVEFGLLPPLLRRLRAEAPGIVLVVRRANYLLMPNLLASGEISVGVSYTDELPANAKRKTVRRSKPKILRADSAPGQLTLDDYCARPHALVSFAGDLSGFVDEELEKFGRKRKVVLAVPQFNGLGTLLAGTDIIATVPDYAAQALIAAGGLRAEDPPFETRAFELSMAWRGAQDNDPAERWLRSRISMFIGDPDSL

SEQ ID NO: 31377 - protein, 138 aa, Pseudomonas aeruginosa
TPSTPTSRTPTSRSSRRRRYRGWGPSAASACRSRTVATRATRSCSSRPRTSSPRPVRCLSWNPARCSPATRSTCRRSTPTSTARRPRPTAWRSATSSTPCRSTSARCTRTTSTASAVPIRSTSRPSSSSASNPSRSAS

SEQ ID NO: 31378 - protein, 395 aa, Pseudomonas aeruginosa
PVRAHPPSAGVQRRPQRSGRGRPAATAGQPDRRAGGRLRPTARRATAREDCPEQPGEPEGVAPAHRATARRRGRCRTRRTARRCAPGGHRRQRAATAGGSRARQAPYRHPPRPTAGRVDSGPFAARPAGDHQGPADRRSRRTAAPPAGHPRRRTAPGRQHRRRRRGHRRPVPAGQPQRLPRLHRRAGLADRLKRRPRLERRPEHQLGRLRPRQRACPPARRQGRRRRRAGQLRTAGAAGPGRIGECLQRLWQAPGAPGLAGPPVGSQPRRRATGGDPLPRRHHRFPGAAGRRTRATLRRRCPGPGRGRAVPRHRGDLPLPRRWLATQRLNRLSPGRWKSATPAPRLQLLVAGLFYAQRGGSVEPHVVSRRWRRGSAGIAAGYSRRSGCAEWIYRV

SEQ ID NO: 31379 - protein, 139 aa, Pseudomonas aeruginosa
WLRPLSTSRRSRGRSSVKRVSTGISTSPARSSGTPRRSTPSPWAGLRASLASSESRSRRRAYPSRRSPSSVGKTCRWLRSSRRQPRFCSRRMTCWLTVDWVRCRCSPARVKLPVSTTLTKVRSRTRSSMHTPTERHYII

SEQ ID NO: 31380 - protein, 236 aa, Pseudomonas aeruginosa
HRRHTFRQRLSEPIDMSLANLCRSGAMLVCAAFSGGAGASDAGALLEAARRGDTAQVASLLERKVEVDAPSADGSTPLLLATANDHLAVARQLIEAGADVNRQNSRLDSPYLLAGAEGRLEILRLTLLHGADLKSTNRYGGTALIPACERGHVEVVKTPLQAGVDPNHVNKLGWTGLLEAILLSDGGPRHQEIVRLLIDAGADVNLADADGVSPMAHARQRGQGGIERLLLAAGAQ

SEQ ID NO: 31381 - protein, 315 aa, Pseudomonas aeruginosa
RAGADRQRRAGRQRRGDHPGAGTGRGQALVPEAGPGGDGPLLGLADGRRRNRGGAQPADRRTLLQLAGRPRRLGRTGPAGAAAVDVRAAKGGAAERWRGAGPALLRQSPWLAAGGVFRADQRRLHQHGGLVAGVLPPARLERPGQRRAGRDHDHLPGARRAQRAAADSPPPRPPALAAGRAAGPARRLLRPAADAAAARGAVGGVDRLRPGRLLRPQPDPDPRPPPRAACGGKPGGLRARHRLHHHRHRALPDRLAARRHRQLPGLLAAARGERGGDVAGDPALRPVRLCPGHGRDARLSGGPPRPPLQARVALQ

SEQ ID NO: 31382 - protein, 429 aa, Pseudomonas aeruginosa
RGLPRRRLAALEQLFQQAGEGTYFQAPQGAGEHGVVREKGRGAEIAQQAGAILAPEDVMRIEVAMADAASMQMGHQRGERGRQAQRRGQLEAQSRRIDVAGTGLQARRPRQVAIGVVEQLQHQPVAPLRMPGELAEHLDQLRMAPRRQAGGHLAGGGAIAGHFALEQLQRHRARRAVRLVPAGAMDDPGGSFADQTVQAQLAPVQRSDAAVGQRRQTAQRVAGVGQPGQARQRRQPGRQALETVGGDPQQFQAFASGHALGQGLQAVAGQHQLLQRPATQFLGQRGNPVVGEDQPAQRWRQGRGRHPLDAVGLEADHAQRRTVPHRRRQFVEVVGGTEQHLETMQPPEVVRQAVQGVAAEVEHLQGVGQLEDFPGELAQAAGQVQARGAGQFAAAQLLQGVHGSTDSGQGGWKAAHDSQGVAERAPSPC

SEQ ID NO: 31383 - protein, 428 aa, Pseudomonas aeruginosa
SGRPESTGPQRMELSPAERQLLLAHRLAVFDGCVVYDAQPPVSAEHVQRLAEGLAGPIPEDLLRLWRTCFGGRLGYDLEVDYDGHRHPFSFSELFYPDSDGYHDLWGWIEHERELAAEAAAEEGRDWNGKLAYLPFGGFEYLERLYVCVEPGPEHGAVIAWSHGLPPAWAGRLHQDSVTRLADDVGGLFRLLSFEQDPFDAENACGVADELLEALDALEAAGEPGKALKGRLEVLLRQRILDWRPALADGSLAAEPRLRQLALAEAAQDGDIDLLQRLRDAGCDFAETLRGRGGVLEACLARGRLEAARWLLDQGVAVHQDSLQIGAAHLDAVLAERLLRLGAISDPNTVLLALQYGDADAARIMARPLLEESPARASALRLALASRAERERSDARRVRSGKMGSNRSPDDYLALAERLERFLAELPG

SEQ ID NO: 31384 - protein, 156 aa, Pseudomonas aeruginosa
RAGVSTSVSDASGIDDPAIRQSVLSEEPLVAALPAGHPLLGQPLSLERLSREPFVLYPGQPRPRYADHVLALFATHGLSLRVTQWANEMQTAIGLVAAGLGATLVPASVQLQHRDDVAYQALADASLTSPIIVSRRQGDGSPHLRRCLALIGREDA

SEQ ID NO: 31385 - protein, 466 aa, Pseudomonas aeruginosa
ERMNATRRSLEQWRDYVGGCLDFRPEEGIFRIARDMFTEPELFDLEMELIFEKNWIYACHESELARPHDFVTLRAGRQPLIVTRDGNGQLHALVDACQHRGATLVRVGKGNQSTFTCPFHAWCYKNDGRLVKVKAPGEYPEGFDKATRGLKKARIQSYRGFVFVSLDVAGEDDLVDFLGDARVFLDMLVAQSPSGELEVLPGTSTYTYEGNWKLQNENGLDGYHVSTVHYNYVATVQHRQQVEAERGGVAATLDYSKLGAGDAATDDGWFSFANGHSVLFSEMPNPAVRPGYASVMPRLVAEYGQARAEWMMHRLRNLNLYPSLFVIDQISSQLRIVRPLAWNRTEIVSQCIGVKGESDADRENRIRQFEDFFNVSGMGTPDDLVEFREAQRGFQARLERWSDISRGHGKWLEGATPNSQALGIAPLLTGTEITHEGLYVNQHAHWRRFLLDGLERLALRAKEVTP

SEQ ID NO: 31386 - protein, 178 aa, Pseudomonas aeruginosa
ITKSPSASPTARPCSCPSATTTCSSTPPCATASTCRWTAAKGSAAPAWAAARRAATAWTTPTRTPSPPPTWSSARCSPARPGCAPTRPSTSTSPRPSATPPRPRRTAAWCANCACSPRTPRCSASTPAPRAASWTSCPASTRACKYPAATAGAPTPSPTGRIRRTTCSSSSACSRAAP

SEQ ID NO: 31387 - protein, 67 aa, Pseudomonas aeruginosa
HFDAARLRDEAFDLYLCGPPPMVEAVRQWLARALPWSIYGCTWRSSPKAATDALSRGRRQLPAGSRR

SEQ ID NO: 31388 - protein, 430 aa, Pseudomonas aeruginosa
RVLLGISVACGSLADSCTPWRSALGAPAQGFRRQLAELPAILLGEAAEVGETEVQGQFGEVAYPAAGVFQAGADALQAQPANVLPRALAKLALEQRVQRTGAHVRLLGQRRDLDLALQMAADVGIEAGEDDLRIAGVLAADVGLQQGQQLAAEDLLEVAVDPRQPLAGLGLAADQGEQADEAFQLVQAIAMFEETHAARRMAPALLGADRFEQRAGQLDDEFLAVRRIGQVDRIVRVDQQQLARRQGVFLPAAAPQAVAAQEDLQVEDALQRRRGDPYRRAVADPAQVEAGEGAVVEAGLRPAGGRQAYAVRTDVPVDIAGHRIGVGTFEHPAALAEQGGIHGQDTQAAIVVVIAARRQAPGAERPPTLRKPSAGDNPGRQSRAVIERNPSNGQRKRAARVSPAGPLARPLQPAAGVSSRGPASRPWVQR

SEQ ID NO: 31389 - protein, 169 aa, Pseudomonas aeruginosa
STGSTSRVSMVEDRMPPITTVASGRCTSAPVPVARAIGTKPRDATRAVISTGRRRVMAPSHTAWSRLRPSCNRLRMKEIITRPLSTATPDRAMKPTAAEIDSGIPRSHRASTPPVRAKGMPVNTSRPSLTLLNMAKSKVNTSSSATGTTTCKRLAADCNCSNWPPQVVQ

SEQ ID NO: 31390 - protein, 198 aa, Pseudomonas aeruginosa
PAGIFTPSCSFCCASSTNEPMSRPRTLALTTMRRLPFSRLIWFGPGERSRRATSDSGMKSIRARLFGGSGISRLDSAGRSARRVSGRRMTMSKRRSPSNRVPALRPPRAVATVSWMSPTLRPKRAALSRSMSTVSTGRPVVCSTFTSEAPSMPCSTLEIFSAVSLSTCMSSPKTFTATSLRTPEISSLKRNWIGWENS

SEQ ID NO: 31391 - protein, 586 aa, Pseudomonas aeruginosa
LPMPTPAIPSTASRTSQRCSMANWMMRSNMRRLLERDSVTVFRRALAQFGFEDEAAAGGDLAAGAQALEDLDALAVADAQLDRLDHEAIGHADEHHVLAVDVLHRAVGDRQDFLAGRLGHLHGNEQTRAPGALGVAQGDPGGGRAGLLAEQVADVGHGALHLAIQRLGEHLDLAADADLAEQLRGHVEGGPDRGQVGQGEDVGGAVHRLALGQVLFHQHPGERRAQLVAVAALQAGIAAERGDLRPRVVQRDLGFLQTLAGEQEFLLGGNALLPQLLLALVGALRQAQAALGGGEFAALVGQLRAADHRQQLALLHRLAKIGRHAVDDPRQARDDMRGAVLVEADLAGQRDHLGQADRPRRIEGDAGGLDLLGIQLQLALLAGEGEVVALLAGHQLEARGEGMRLGDPGIGHQAIAAGLEQQVLDLAGGTLDVGAEDHLLRRQRLAAALDPGLERAAVLRHQQFQGQVALAQQHAAARSAALALGGRFAGAGRRLPAQLQVGAAAQAEQCQCGHRDNRLLAHSVLPNRSGGAPAARPGNLTGRGGRCLRRAGAPCSPAPVPRRPARARTGHGRRPGCAGHRARRGS

SEQ ID NO: 31392 - protein, 245 aa, Pseudomonas aeruginosa
LYSNALKHLLANESILYIGANMRILIIEDEVKTADYLHQGLTESGYIVDRANDGIDGLHMALQHPYELVILDVNLPGIDGWDLLRRLRERSSARVMMLTGHGRLTDKVRGLDLGADDFMVKPFQFPELLARVRSLLRRHDQAPMQDVLRVADLELDASRHRAFRGRVRINLTTKEFALLHLLMRRNGDVITRTQIISLIWDMNFDNDSNVVEVAICRLRAKIDDGFDLKLIHTIRGVGYVLEARR

SEQ ID NO: 31393 - protein, 159 aa, Pseudomonas aeruginosa
TASAGWPPRSARRISPTASPSRTCRASWTAWPAASTTCSAASRMAYASSRSSPTTWPTNCARRSATCWCATRCCSASIATARHTAKPWSPMPRNWSGCRGSSPTCCSWCRWTTRRSRPSSAASPCTSRRPRSSTCTRWSPRTRASNCACPATASPTATT

SEQ ID NO: 31394 - protein, 1136 aa, Pseudomonas aeruginosa
RAWTDSSPGVPVEPGLGVQVQPALLAPGRPATGQAVEVEIDHRGGEQGQDLAQQQATDHGDAQRLAQLGAGAAGEHQRQRAEQRGHGGHQDRPEAQQAGLVDRLMGRLAFVALGVEGEVDHHDRVLLDDADQQDDADDRHDADLLPRQHQRQQRADPGRGQGREDGHRMDEALVEDAQDDVHGHHRGEDQQQRVRQRGLEGQRRAAEAALHAQRQLQAGLDATDRLDRLAQGVTLGQVERQGRRGELGDMVDRQQGMPLLHLRQARQAHLGAVAGRHVELLQGLRAELELRRHLQHHAVLGGLGEDGRDQPLAEGVVEHAVDVGELHAEARGGVAVDVQVGLQALVLPVAGDVGELRQLLQPRHQLRHPLGEHVRVGVLQGELVLGAGDPVLDGQVLHRLHVQLDPGQVVEFGLQALDHFAGGDVALAVRLEVDQQAAGVEGRVAAVDADVGGQAGHRRVLQHHLGKGALALGHGLEGDRLRRFGDALDHPGVLHREEALGHGQVEQRGQRQGGDGHQQGQRLVPQDHPQGLGVLCDQAIDDPPRGAREAALLVLVDVAQQLGAEHRRKGQGDEAGNQDRHRQGDGELAEQPPGDVAHEQQRDQHGDQREGQRDDGEADLLRALERRFQRRVALLQVAGDVLHHDDRVVDHEAGGDGQRHQGQVVDREAGQVHHAEGTDQRQRHGEAGNQGGVDVAQEQEGDHHHQRHRQRQLELHVLDRGADGGGAVGQHLHVEIARQGRLQLRQQRLDPIDHLDHVGPRLALDVQHHRRQVVGPGGQAHVLGVVLDAGDVADAQRRAVLVGDDQVAVGVGRAQLVVGVQGRGTGRAVEAALGAVEVVAGHRAAQVLQAQPRRRQRRRVGAHPHRRALAAADADQADPGDLRDLLCQAGIHQVLDLRQRHAVGHHRQGQDRCVRRIHLAEHRLVRQVVGQQALRGVDRRLDFLLGDIEVALQAELQGDHRGAAGTAGRHLVEPRNLPELVLQRRGDRRGHDLRAGAGVQGDHLDGRVVHFRQRRDRQEAVGDQAREQDRHHQQGGRDRPQDERAGRVHSALPLPTESPWRPLGRPVCGFCGSPSRTCGEASATRTSIPSRRRSVPSTTTCSPAFRPLSTTTRSFSLVPMATLRWLTLLSAPTTYT

SEQ ID NO: 31395 - protein, 185 aa, Pseudomonas aeruginosa
IPLVPRCTALAGMVSTPLRVCASRRTLTNWLGNSLPSAFSKRALSLTVPVVVSIWLSRVVRVPSARTLSWLRSSAVTASLPGPFICSTTVPICCCGRLNTTEIGLTWVITTSGVVSPLVTRLPMSTWRRPRRPEIGARTSVKVRLRRASSTWPWLVRMVPCNWRTWASWVSRVCLAIESSAYSPL

SEQ ID NO: 31396 - protein, 129 aa, Pseudomonas aeruginosa
VRGSTTASRSPALTSCPSWNSTLTSSPLTRGLTFTVLKAVTVPSALKCSARSPCSTLATPTVSALALGSAAPGLPPRPGRPSEDGAEAGAASHITRPITAAKARAVISHGRRVRNLDLPVVGVMVLLQA

SEQ ID NO: 31397 - protein, 506 aa, Pseudomonas aeruginosa
QQTACSVTDEGLKYSVLHSPTPQSARDAQMIDPLKHRFAALRSRAEFHSLRYVQRSGEYLSVRRNVNEPPHFSQDRGAMLCVRLNGVEAYAATNDLSAAGLQAALEQAERQAERIARHALFDVRGLPPASGRSQYRSPNQDAPFPSLAECYELLAEESAKVPRDERLVNWSVFLEVSRQEQLYLNSAGAEQYHEQRFVYPGASVTAYDGHDSQTRSFGGHHAGQQGGAEVIERLGLVGAAPRIADQALQLLAAPNTPSGRCDLLLMPDQMILQIHESIGHPLELDRILGDERNYAGTSFIKTEDFGRYQYGSSLLNVSFDPEIPEELASYRQDDDGSPARKEYLIREGRLLRPLGGALSQHRSGLEGVANSRASSWNRAPIDRMANLNLEPGDKSFAQLVAGIERGVLMSYNRSWSIDDARNKFQFGCEWGQLIEDGELKGVVKNPNYRGISAQFWRNLSAVGDAGTFEVLGTPYCGKGEPNQVIRVGHASPACVFSDVDVFGGDA

SEQ ID NO: 31398 - protein, 448 aa, Pseudomonas aeruginosa
PGASPSRSEPARRSPAVRRPGAPRAQSEERPPIFWRHYHATINGPAPSSFSTLVTHAREEPTARISHSVHGGEAMPALSRRSFVTLTALASSSILLSPRAFAGSGATSAAGKPQETFLDFNESPYGPSAKARAAMQRAAALCGRYDYDAQDALVGLFAKQNGIPAECVHAYCGSRQPLQYAVAAFTGKERRLVMADPSYDSVVGAAQVQGAKVAAVPLDAEAAHDIERMLAAAQRDAGLIYICNPNNPTGTLTPHERIVRAIERKPERSVVLVDEAYIHFSDAPSVVGLAIQRQDVLVLRTFSKLYGMAGARLGLAIGHPQLLARLERFGGHNVVPSPTAHAGLESLRDDDLVPRRKQQNAEVRERTIAWLRQQGFRCTASQSNCFMVDMRRPAELVIAELEKQRVHVGRPWASWPNWVRVTVGSEEEMQAFRSAFASVSRRHQVAMR

SEQ ID NO: 31399 - protein, 79 aa, Pseudomonas aeruginosa
AIALILLVSEKPPALWPAAEAFGAGDDASTLYPSENLGFERRRPPRLNSWPWRNTPGSGGTPPDSAAARRSGWESPSAR

SEQ ID NO: 31400 - protein, 406 aa, Pseudomonas aeruginosa
TSTPASGTGRCRESAPASTAPRPRRSGRPPTSASFPSAILILVRMNAAWRQRASGTRTNIPARQAKAADPNEVLSAKSRKIFARKACVSLRLAGRLATEQFHQPVDEHPHPRRQLALRGIHGMQRQRWRQPFSEHLSEATVGQAGGDVIVRRLDQPEPGPAGGDVGIGVVDADPAAHRQRAQTPVDAELEVEGTPAGRRLVVHREVPAELGELPRMAMTLQVGGAGAGDLRQVGQVPADQAGIVQFADPQHAVRALAQQVDQAIVAAQLQLQFRVALAELRQERNHPHPPQCARQVDPQAPARVVQDAWKAAFRLLQVRQQAHATLVVGLPVEGQAYLAGGALQQLHAKVRLQLLDRLGHAGARQLQAVRGLAEGAQLDDAGEGLHGLETIHRTPSIIWKIRMVKP

SEQ ID NO: 31401 - protein, 212 aa, Pseudomonas aeruginosa
RGTARRGPARQTRAGVPGQQVRHRPRPCQSPGARRRRQPGVHPPRHRRQPEAPRYRPPGPVLSAPHGPAGTHRGQRRRPRRPGEGRQDPPHRSQRSLGGNPRACPPGAPDQRVAERVLAVDPRSGGHRGARRLPSPGHRLRPLQPAGPRFPYRHPEASGRLRRRRLPSFQPALPGRELREEPEAGGQGRRTGRSQGRETLATGAGLGAGAGR

SEQ ID NO: 31402 - protein, 402 aa, Pseudomonas aeruginosa
RYPPYGSLSLAISWLPTRRENDDGAAAIGNRPAPLGARRTSGRPPVAHHVEEDRRGEAHRVQAVEHATVTFDHVPPVLDPTVALDRRHHQAAEEAQQVDQQRDQRRLPEVERGDPPQRGADGGGQGDAADEAFDGLRRRQVGSDLALAEQLAADVLHHVGELHDDHQVGDQQQVAPLEAGDVEGQQRRHEGDTEHRQHQAPLHFRGAFEEVLGVAAQRGEDRQQQEHVHRDEDREHAVPVDVDQQVLHRQHEVERRHQRRVVAAPGRGEGDELAQGVERHAIEQQDHRRLAKPEGETDHQDHRPPGVDPCVQVVDHRVRAGTGAPLEDEADQRGEQQQRADPAEEHPGLFVHLRPPLPAPGPAGPCALVRGTPPCLLPPWRPAACRSSGCRAAATAACGPWA

SEQ ID NO: 31403 - protein, 773 aa, Pseudomonas aeruginosa
AGAGSGCPARACPAATTATGRRAGRSTSTAGWSRATAASRVPSRRPGCRRRRAGWSTSWPGHSWRRRTGRGTAARAPPASVPPARAAPSAGDLLRQRYAEDAPLVDPLGDLAEAGGGHQLVHFRLGPAPHHPGLALAVAGQRAGDQFQLRVPGLSGVNQVAALLQRLAEAGEGVADHAVVGEQLVEPGNHPEARLRLQRRQVGAIEGVALDEAGDAGEALAFDQGAAVTHVDLAVVAQEDAFRQRLDALQGFEDVAAVAGGDVDDAHLALLLAQPLHGQAQQLLSVQLALADAAPADGVQVVAVDQATQWAAAAGLVAVDIVEGAAGIEAGVEAQLDPIRPQAAQAQAGTGGAPVEIARRVLRQRRGQRLGLGAGMAQAVGIEQARSFGGRGECLEEEAPGTADGQVTIALAKGVVEEAGQDVLFLAQAAETLEEALLRRTMDDEVGPGNQQLGGNLDRLCVRYHPLGSFVEAEQDVHRDRLGDQRVAVVGGDPLRVVTEEACLDIAVDEEIAAPQAHQFQPAAGERHVELDLERRRSQHQCAHLRRVVVGPGGNQHRADALRHHRHPLFGDTVDGLDMVDEGLYVAHAGSKARAVAAGAWREAVATGVPGEEVVFRQVEFVDQMGDPPGVLMAAVEQQHRLARAVRRRAAGRPVAVEELYPVVGGETQFLYVAHVMSLCRCPGRDPGGVASCGRPPPWRSPVPSQAWPLLPRRLADSSARPWRTRLPMVSNSRAAISNISQSIQASGNRPLATPAPITPKHSARSLLPIGPS

SEQ ID NO: 31404 - protein, 486 aa, Pseudomonas aeruginosa
HSASRVARHPPAGLAFLFCQDAHHENRLFQYQRSARPAAPVGGADRAAPARRDRAAGNQGRRRPVSPGRDRGARLPRPLPRAERPLRRRPALPPGAPGTASRLPERRRGIPAALHLGHLQRRPGQPDHRDERLLPARREPRASDQVPGQAALLRRSPVAAGEQLQARASPGGDGRHQYLAGGLRHRHWRGKPQALAEDRQVQLPAGRARMAGYVEELGPGRQLPGPESGGERPLQLVRLPQPWLRGQPQARPAHRCDPGQPGAAVALQGRRHRLRPARHGEALRSRPDLAGTGLRLSPRKRLIPRMSLQAIATWSGRSRRRRPPIRRGAFPSGRIVHPRPLQLHSIAIRVEKVQRPAVALGAEADFRGNLRDQAEPLEMGDQRGLVERLDAHAEMVDVAPFPTRSRTALPAERPGHRDQIEHRRAQAQMGQLQVVAPLHHHATEDIAIERDAAFQVADPQDDVIETFDDEGLHGHSPLGPWTMARL

SEQ ID NO: 31405 - protein, 152 aa, Pseudomonas aeruginosa
LLTVNYPRGSPHRPQGLPRRGREWRLRRRGPADESLAGRREQERRRAGSAPQGAPDQSHHPQHEPDRGRRSLPAAPGAHPRRPRGRRRRAHFDAAGPQRPAAGQRPADPRPHLPDPGHSGFSPALSGPAPGTAPAGRPPGPDRRRHRPGPAW

SEQ ID NO: 31406 - protein, 473 aa, Pseudomonas aeruginosa
KTMPAMPHRQRASDKDLWSRTLSLVFLGFLCYAFPWSVFAAPLPIPTDDTPALRIQGSNTIGAKLLPALVEGLMEEEGLEDIRRTPGERENELHLLGKSRDGRLVRVELSAHGSSTGFAALLERHAELAAASRPVKDSEVRALAGFGDLRSPYAEQVIAIDGLAIILHPDNPLASLHTAQLAAVFAGEVRTWEELGGKGGAIRLYARDEQSGTYDTFKELVLASHGKSLASDARRFESNDRLAAAVSADPHAIGFVGIASVGRARALAIADGESLPMAPQESLIATEDYPLSRRLFLYLKPGEKNPWAQALVRFAQGPRGQAIVTRSGFVAQKIQAVQIAPRPQMPAEYRKLAEQARRLTVNFRFQEGSALLDNKALLDVQRLLDYLRQNRKLQERTVLVGFGDPKSDAERSVLLSRLRAMAVRRELARGGVSFREIPGFGDELPVAQQRPGTGPTEEPAGGSLGLLNAVATL

SEQ ID NO: 31407 - protein, 496 aa, Pseudomonas aeruginosa
PRRFAGARSLVYFFRVTAGPSDGKQLPPCRSHMTIRQFEARGPNGSSACISHRTVPRYGYLVLAGLPGHRHRSPGPRPRRAATRPPRNRRARKPATVRRLLRLRPGLRRLGLVRLRPHQRGGVLHRLPGRTVAIDGQRVRHGDDLQFLRHPPPLPAPGAVLGHPRRHRPAGDHDRPGRRAGEGVRLDHVRVRRLPAVQRREDAVQQARGRTRPRAQPGAAFPAQAHAGDQGTARASLLRPPAGRQRQAGALRHPAVLRPGADRAGRPGVRGGQRAGDLRHHPGPVHRLHLEHLRHPRPARPVLLAGGDDPPLRLPEIRPGPGAGVHRCEDHAPRCDRQDSRRPLAWRNLRPAGGRHPALPAEDPHAESHRRGQGRTECRTRSGSNVWTPTLNLSGGSASARVGSASATSGRPASSPPCCTAVARGSWNATPRKKGRSPRNEKGPHPRAFPLYHSRQRLLRSISLGTYLPSSNLPIAARCTSSGPSARRRVRCMAYQ

SEQ ID NO: 31408 - protein, 325 aa, Pseudomonas aeruginosa
QEKSRSQCHEPEQSRPEPVHRVRCDLYRSQPDPRRADRRHHPASRIQRPFPAARDLQRPAIRAHRPRHGADPYGAEHHRPGAQRAAVAAGFGAGEPQLRSAAGEQDLPHQHDRPHRSGHPPPAVPALAPPGAERAYRELPRQAPRDHQGTRRRPPRLRRRRAAEHRSPGAPRQADGGPLRLRHAPRPPTGGQAEAGPGRLPGPDPHPYFQPPQRPRLHRPGAGQDGHPAQDRAALAALPDGLHGGPADRHGDDRAGTLRPSPRPALRGAAGERRAEAGNPPVLAREHRSGPGQPLDARADHRAVPAGHRAREQGGAAGVSACQGA

SEQ ID NO: 31409 - protein, 419 aa, Pseudomonas aeruginosa
SPLQAARDHQALHVAGALVDLADPHVPIDAFHREVLEVAIATEGLDRRGANFLGHLRGEQLGHRGFGQARQAGFAQAGGVVDHLPRHGDAGGHVGQAEGHRLVLDDRLAEGFPLMGVVARRLERRARHADRLGGDADAAAFEVGQGDAVALALLAQAQRGRDTQVVEGQLAGVRGVLAELVLDPHHLVAGRVGGHDERADAALSGIRIGDREDDHHPRVAARSDELLGTVQHVVVTVAAGAGLQEARVGTGLRLGQGEGAEHRTLGQRTEEALLLLGAAELVDRHAADRVVHAHDGRAGAVASGDLLEGHGVGQVPGLRAAPFLGHQHAEEAEVGHLADCLGRETVLAVPVGGERFQPFLGELPRHVTDLDLFFAGNHRGFLFFTACISASARRRSRSPRRRRCRPPPRRVPGRTAAGR

SEQ ID NO: 31410 - protein, 274 aa, Pseudomonas aeruginosa
RSDLRGSWDLPPVLAGGHADGAVEANHFAVEHAVLDDLPDQRGVFVRTPQARRERHAGAEGVAHLLGHAGHHRCLEDARGDGHHPDAEARQLAGDGQGHADHPALRGGIGGLADLPVERRHRGGIDDHPALAALVRLALGHGLGGQAQHVETAHQVDVDDPAETLQGMDAIASEDLLGRRHARAIGQAMEAAEGLQCSGHGLAAVGLAGDVGPDEARLGAKLGGIGRAGLGVDVGQHHLATLLHQHLRGGGAEAGAAAGNQEHSIFDTHVVFSC

SEQ ID NO: 31411 - protein, 305 aa, Pseudomonas aeruginosa
FMAFPCCGCSGNVAEPSSCAARALRRTPASGVGEVEEHVYVNVKVNARGLSAQGRRPRRGPTERRRMGGFSQEHSMTPEIAIGLVTALGLGALVGLERQWRQRSSGMATHAMVALGAASFSILPLLLDNEVSVTRMAAQVVSGIGFLGAGVIMRDGLSVRGLSTAASIWSTGAIGVLAGSGFILAACMTTALIVIANLFLPALGRVVDRHTSGEAEQERFYQISVSCEARNEALVRMQLLQRMGDNRLNLQSLESHALKGSGNVEVNAVVFTLHKEDSLVEQMVGELCLAPQVTAASWVMNPAAE

SEQ ID NO: 31412 - protein, 614 aa, Pseudomonas aeruginosa
HSSQRLTEAPQNIHASYFPSSALARPLRRPQVVRSAVDTLRAGTRAMPASPGHRDVLGCLVAACVPVQPGNPSRRSMLQQSLRAQILVLLGGSLAALLLIALACFGSLTGDVRAYRELLGGPVRAAQLIDEANLQFRGQVQEWKNVLLRGRQAEAQTKYWSQFEAQERAVQDILGRLGSVAEGELKDRVERLREEHRRLGTAYRQGRQRFLEAGADPIAGDQAVTGIDRATTAQMQALRDELHQASDLHSSSISAEARRTMLLGSLVLIGASLAVALLSLWLVNRNLVRPVQRLIEHIAQLSHGDFGERIEIRRKDELGKLALAANTLRDFLVDIFDRLRRSTRDLDSASGSLNAIASLMAAGTREQFSRTDQVATAMQEMSATAQEVARYAGDAARAADEADDSAQRGEDVMEETIRSIGEMRKEIDHTVEVIRQLESDSGRIGKVLDVIRGIAEQTNLLALNAAIEAARAGDAGRGFAVVADEVRTLAQRTAESIAEIHQIIDTVQNGAVNAARAIESGQSRSEAGAEQVANAGAMLRQITASVESIRDMNRQIATAAEEQTAVAEDISRNLTEIASIASSNQEQVEQTEAASRDLHGLSAQLGDALQRLRA

SEQ ID NO: 31413 - protein, 691 aa, Pseudomonas aeruginosa
RAVMLADIGRVRLPGNRFRRAGVGVEGRTGMTAINLHALSSLQSGKRARAPRNKGTMTSLIADARHRSSPGVQHGNPTLSRGRAFETGLRRPTRSAGRRCGRGIRGNPRRRYVLLPDAHRAHFHPRPSAPVVSREHRPRYPADAATGFVLRLCDPGQGSIRGGRRHPRPALPGQPLCARRTAHPLLRRGSAGHRGRSQPRQPLRHRPGTTRAAGRAGRRHARALRPAGDGPYPYAPLDQLHRRANRPVQPSPPAGGRFPAPAARRRPHRDRRRPPAPRPAEYHHPYAGLSLFQRPHARGARPHPRGTAGFHSLQDQPDALRTAPATAATGRNRVGLPPPAAGLRKPRRMSRDPDQGQRGPRRTTACRRSPRRRSGLAAPGGQRGRRRPRPRCRLGPLQPAAGPGPAACLHIADLAVPGDRNRRRLPSGVSAENRPADRQVHGRGSAAALAAPATRLRQPRRIRAPGGENRTDAPPQRLGAAPCHGPAGAMERTEHPAQAGDQRIGIGHGRQQLPGRGRQTRQNLQHRPFRPRAGIHRKRTHPRRLGGRLGAAACPGAWHGHRGGRLRHRLQQLDLPARSANHRHQARPIVHPRPRRLAEGAERHPGGDRPGQPVGLSGGRGRHRDPRHLPPAASLGLPRGPGLSDRPADAAGATGGLAAALANAGTWSGPYQHARQPRRVAQGLASKAQTR

SEQ ID NO: 31414 - protein, 109 aa, Pseudomonas aeruginosa
IPVHKRKRRKTLIRDPSLSAKHSNEEVPPTNSCRRKEDNSASELNIFGKEIKKQEQKITTKNQTSKDNYFKLNKHSRSPARANPIRSRTRMKSLQGRGGKEGNVDSLTR

SEQ ID NO: 31415 - protein, 541 aa, Pseudomonas aeruginosa
SPSKRSKAHATRCSCASRSRRPRRLPSDLEALHRRAHGRCNLVQAPGGGGHLVHRLGVLLRTLGDELHALGDFITGARLLADGLGNLIDHRRGMTGSIEDLVDRHPCLAGERHPLVDPAHAGLHAVDRLPRAGADALDHRGDLLGRLGGPRRQPAYLVGDHGETAPGLSGPRRLDGGVQRQQVGLLGDPLDHLDDRMDLVRRLAESGDAGGGLVDHVGDAAHPFHHVEDHLPATAGQLLGLGRDHPGVVGVVGNLRDIGDHLFHARGHAGGAVGLLAGTVDDRLRGLADGLGGVMELFAFLADDGDHLPQVLLHLAQGPLQLSGLIVAVDTDRLLQVALGDHPGRGDQLAQRLEDGAQQLATKLPEDQAGDQDAAREHPGGIAHAVFARPVGLLDVFLDQAAERFVAPFQLLEGLDELRQLGPCRHGIEQRLADDALGGADVGFQVGPQLDQRLVDGVVERQPLVLLDHLAKPLAVLLQVLADLLGRRAVAGLDHERRQDVGAQGVVHHVAFHVVAQRIDAQLVLRQRLAQPQLPPEADPA

SEQ ID NO: 31416 - protein, 476 aa, Pseudomonas aeruginosa
QHHSHDADGARSEDSLPNVHPWAPFRAEISLRIVNPRQGGIARTKSYSGTERGRRPFSGSCRPLALFGRQLELFARIVGPHLGVHDRPPQRRDQRQHHHPGITAGHLRAIVIMTEDLIGAFGEGMMVGMPLQMEQDQVGEDEVAVPGVGMVGPLVAPVLALSPMQAVVLDVVDDLQQCHRDERLAKEENHPQPAERPTETDQQRQAQQVPPDQFVLPAEHRQALLAQPHRFKAPGVEEVVLVGMRQELVDRLAETRRRSVLRRRHMHMVAAHMLDLEPRVAHGGQQNAAGSLLQRRVLVDQLMGDDDPHRSHHRAHREDPAQPAEPAPLLESDEHASGPHQRTDEHRHRGQGQQYVIALAEQLRRLRFLVGVGRVAAEQHVQQRPDAEYRNHQGKCPEGRMCAVLGHPVVERHGQRQQQPEPIGVLLDGQHGAGREIFKHRALQFLSDNPTIEPSPSRAARSPSLKVGRLPGLHPA

SEQ ID NO: 31417 - protein, 408 aa, Pseudomonas aeruginosa
RIPLLHQEPPHHLRPGQATARLPGENRRTGQGGRLAQPFRVQLAELAGGRPVRRRARAVLEHRQGRVEEDRSRRRFRRHRNQAQFLRRRCRHRTVLRRPDGSAPASGAVRPLRRQLPGVVGAGQRHGPVRGLDRPRRAQGRRQPAALQPAGRCADPQDLEPAGKLEAARTDAFRRHRRSGGRESLHRRKRTLQGLRQLIGRDRRRKAPPRRGAFSFPRASAATHRRPRQAHAPTLLHARRGEQDGSHAKPLGQAQAMFEDQPVHQDRRDRIDEGQGTGQRRRQFLNGAVEQYVHQPGMDDSQGRQAGPGSNVPGQFGKVRQRCEHQHAGAHLDQGDKMRRRALQALHDQRGKGIQQRGSERQEDTEQVVPARGVAVAVGADDRQHAGERKPQPAQLARRDLLAEKRRA

SEQ ID NO: 31418 - protein, 152 aa, Pseudomonas aeruginosa
KKTFEADMTDDIDQRLINALMADSRLSLKALAQVSGLSAPSVAERLRKLEERGVIRGYTLDVDPRCFGYQFQAIVRIRPLPGRLHEVERQIQDIAEFTECDKVTGDDCFIARLQVRSMEQLDTLLDRINGYAETNTAIVKKSPVKRRLPPMT

SEQ ID NO: 31419 - protein, 238 aa, Pseudomonas aeruginosa
ASSREPGFRPATPSSEATRGPPSNSAGAPEHPVQVRLVGSDGSRDVRALHHIHREERRQAGHAEELVGLVEGEIHRIHAFPFEEVARIVERLPWCIPGRRDHVALALHQTAAAIFLRAVGAGTTVVGIEAAMTGREDFVDVALHRPRGAHPPAGHLVDHHVGPEELVHLRRDVIATVDEGLAQVEATAVQMGQGGFVQGLVEATVGMCETLSAVEQENVFHGVPYMLEPQRRCLPIPG

SEQ ID NO: 31420 - protein, 349 aa, Pseudomonas aeruginosa
GYLMKTIARRLSPFAILLPASLLSACASLGNAGLGGSQQNPTNQLLNMIDEATREGMSVVLVPALMPNKSVTDLSSYSHRVIFKNKDVPGIAYMQAFANNDLEKIKEAVYLWDFLEVNIVPPGTYLLSGGIDYKIDSTLAQIKAPKGQPAASPLGSVNLSAVLYRRFVKENYWRDASYADKTYTQNVCSAVHMASGQCVGWTEQQYSQREMVSDAGWAEGTKIEDVPSIKLQAQIPDAYAPLSFTIQPGQILLSDRFHLKTPAVSYDRKTCKAVDTQNIKCALQDIQVFMRPAPMELTKRFIDREQPRLDETGRQVLARIQPMKTEILGEAGMEDLTWGLPVSLKRKAR

SEQ ID NO: 31421 - protein, 168 aa, Pseudomonas aeruginosa
PFDLKRFLAHPSLEWTQLWTDSPSLASALRKKLCRSGYCVAQAGRNGPRRPRNGPAATGNRGARQDPTRPAPAISSPRGSLRLRALQASAPPWRPAPRHPPVHAWRASRASARAAGETPAAAHTPPARRLPCRQPGLADPVAAHLPPYNSSSGCPGTRWRWPVSVVRR

SEQ ID NO: 31422 - protein, 182 aa, Pseudomonas aeruginosa
RAGRLVRSIPGLLPPSPKSEATFADLLSGRRSAAIPKRWPWDGSVERGSQSNRRTKAVQGAMNRAPLECDSHTSDVPRQHLAASRLAGETKGFAKRTAPVAGKAARRTAPRRGRSTNGYGTWRRNEKRARRPFLNDLQTSLELYRSIFGAGNETRTRDPDLGKVVLYQLSYSRIVLVTGAIL

SEQ ID NO: 31423 - protein, 106 aa, Pseudomonas aeruginosa
PAAPACMRRVGNGSSSQTVTTTTLMSGWLRSSLRVASRPPIPGIFTSIRTTSGFSSRASFRQSSPQSAWPTTCKPSMSASMRVIPVRTRSWSSTTSTLITLHLVAH

SEQ ID NO: 31424 - protein, 343 aa, Pseudomonas aeruginosa
PMSPSENIQYDFEWRPLNNYLAVQRITPPDMRQGSAAEPRLPSEALYEWIVLNGRSPLEGLSLGEHYRLSDYGVAGLALQSAGTVGEALQLIKTNMLLFRKDIRGIAVRRSSCDTVDVDIDLQDKPDWPQSARLYHANVLASAAYAVFRDLLLGELELVRLRLPERNGDVRAYEEYFRVPVYFAGAGITFTLPEELLEAEIATANSAVFQASLALGSKAFNTRVTREMGGYRQRIVALLEVLQDRYPSIAWVARQLKVTERTLRRRLADEGTNYREVLDLVRHDRARQLLRDERLRIEEVAERLGYMDTSSFRHAFRRWTGQCANDYRQARLAGKTARRQGER

SEQ ID NO: 31425 - protein, 242 aa, Pseudomonas aeruginosa
TARCVAHQEPGHAEHRRQGEGQRHPRRRHAVEKPAHQRLRQHHADPQRRQRGARLAPGQTALHQHRHAMGHDPGHHEHRQYLGCPAPARNWRCARPGAPSIRSARFPLRPCRRPRQHPALARGTARPAAAAPGPVRARRRPGKRRASPTLRGSGGRPAGPAARPPRSPGLTGRRPRPGVGGTRVRGYVRKAGCLAPAGRSAGTARRVARRHSPPPGRAAAATGPRSARALSAARPNGRSASP

SEQ ID NO: 31426 - protein, 121 aa, Pseudomonas aeruginosa
SRRASSRNSTATGSPTGRTSTRTSSGSFRPTIPAIAMPYLISGEPPGSPTTWTRSASCSAPTRRSTPGTWSSRRRTSPASASAAWPRWTPPPSWCPSPSTTWACRTTARIPRTTRKPRNCC

SEQ ID NO: 31427 - protein, 467 aa, Pseudomonas aeruginosa
VLRRGGRRRGIRTSGCRRSGRPARRQPPTGRACCPSGRPGAGSRARRHRPGRRAGREAGTGSGSDAFRNSSTLADAEVGGQLAGHFGGTGGQAEVERRGDLQRLRQHAFGMEEIGGGLQGGGNLRTEDHRTDARLANPAPSDFARHVQILGQGLGERLRVPQGPGLGTRQAGQQVADRGLLAGDRSVAGQGIGVAGHDPGTVVDDPRLIEQHGAGGIGLPGHPGVYRATHQGGAAVHRTKEGKAYVLRSEAGATQRAKGEEMPPAAAIDGNALALEAGHRTDRRVLADHQRHGRRVEVPGAHRLERRAGSVDEEERDVAGKAYVQGPGVERLEHRCTGGERRHFQLVRQVVELAGRAQGGVAVALHIAQAQADEVGGAGGSSQQGRGQQAGKHTQGSFHGQSPGSSARSRGYPGLSVPPVRSPTRPGSRIVGGTFQRLSAALPAALQTLSFLWRVDTSAKHVAVVPL

SEQ ID NO: 31428 - protein, 218 aa, Pseudomonas aeruginosa
RIVPAEAVVAAQFQGLLDHRQRVVDDRDLEQPGVAGGQLSAARGIEQQAVLQEQAVDLAERLLHPRQARQRRAETGRHALAQPADEPLAGAPGDTVVESAKQHRASLGEVAQHGLVRRRRLVVGMQADGVFQRHRHLFEEHLVAAAGAHAQMVPALHDTDAWAVAAHQPGTHAGDRLVAARPYRQPGQAGNAGGVELVPGQLPAVADTPRQRTRQTAA

SEQ ID NO: 31429 - protein, 193 aa, Pseudomonas aeruginosa
VSSELLNRRAATAAGGRYGHVWRESGPGRSARRRRAARSLESGRSRRPAGSTRQAQRQPARGCLPGRWSSSAPRSAGPRRSTNGCRAPRPARRRPAGAANRRSAAGGRAAADRGAHGSRGPVRAPRRHASRRPPRYPRRSAGMTPRSADRVPGPWRRRALGGYARRPRPAARPRACRCRRAWRRPRWLRRRSH

SEQ ID NO: 31430 - protein, 60 aa, Pseudomonas aeruginosa
SCREFPRSRCCPRLGRSTDKVGGCRYKKNICMGAFLRSYRLKLHDGNSFLSYLNMLNTHI

SEQ ID NO: 31431 - protein, 146 aa, Pseudomonas aeruginosa
QPSLPLPSEAKRGSQGNVDPDCSPFSFTLPSPGDLPAPLLNRLAYPTPRPPPCRTAVPAFPDCPAGADAPARAGSAAGNPPVAAPATDRGSGYAPGPAPAPGRDPDPRRPGPVAARCRKSRGSVAGPGPDRPGPVAGRHGSRSHRG

SEQ ID NO: 31432 - protein, 136 aa, Pseudomonas aeruginosa
APSHGGSNRAGVAPGWHCRGRPPRRVPCALGAWRRVLRGTPCLAETTPLPRPVRHSPGAPANGCPSQCRPARAAPGTRRPAAEGHPATPPRRYSAARPGAARHLVWRHRPPVHAGHPPRAAPAGTVRRPAVRWRWV

SEQ ID NO: 31433 - protein, 288 aa, Pseudomonas aeruginosa
HHRYPVAAQRRHPQPGGGITQRHHRLDAGRSATGTRPDATLRCDLAGHTQGRRPARPCRRRPRRRRTPRPGRSGPMAGRARPHHLPARRTHARGIRSRSPAWLPLHARWPAGSGNRPCRQRARRAPGTGGRRWRTRQHERLLAGPDGLAGRGTGRTLRRRLQREGRLERAAAEATPGRHHRPDHPRRLAGRTGHPGARLHRQRQLCETPHPRRRLGIAQPVEAGTGTAGHGRALRTHLRQQPAGTLRRGGSPGTQRQAGVPSRRRHQRLGRRGPADGRRRKPVGVAAH

SEQ ID NO: 31434 - protein, 290 aa, Pseudomonas aeruginosa
DSNSRKSLPFDGFQDRCLKPLGHTSASRGAIVPDSNTLSNSIDWPWQRLCYHAHQYVMDPFPLRSTHTMQEQQYQLNSAVAEQREVSGVLRNTYGLLALTLAFSGLVAYVSQQMRLPYPNVFVVLIGFYGLFFLTVKLRNSAWGLVSTFALTGFMGYTLGPILNMYLGLPNGGSVITSAFAMTALVFFGLSAYVLTTRKDMSFLSGFITAGFFVLLGAVLVSLFFQISGLQLAISAGFVLFSSAMILYQTSAIIHGGERNYIMATISLYVSIYNLFISLLQIFGIAGGDD

SEQ ID NO: 31435 - protein, 250 aa, Pseudomonas aeruginosa
NSPSPYSTLPTPPPPAARCASAKPRWPAGTKSSACSSTRTACTAPRPTSWSGPEQFQPGPPAWARVCRAQRPGRRGLHRRRPAPRRAERRGSRTLRPSRRQPWRTMGTVRTRPVARGGAKRGPPGLLRRRPMSQSLLIISRQSPWSGPSAREALDIALAGGAFDLPVGMLFLDDGAFQLAPGQHPAHLQQKDLQANLQALPMFGVDDLYVSARSLRERGLAEERLALAVEVLDDQALRDLLQRYDQVITL

SEQ ID NO: 31436 - protein, 485 aa, Pseudomonas aeruginosa
CRRKSNCSPCWKTSRRAVSRTSPLAWWRWTTPASSNSPPASTRSTVGYDAPYAGRPGNPAGQGRLPRRPRRLVGAGGGSPGRPRGAGPDRRALGDSPTAPRVLCGVPAVSGQPPADQVRRPATGSGQGQQPAPQPPVQGRPGQAWREAGRPAETEQLSMTLSTPAEHPFAQFVRILGKGKRGARSLTREEAREALGMILDGRVEDTQLGAFLMLLRHKEESSEELAGFTEAVRERLQVPSLRVDLDWPSYAGKKRHLPWYLLAAKCLAGHGVRILMHGGGAHTAGRLYSEQLLAALEIPLCHDWLQVEQALERGHLAFIPLGAWMPVLQRMIDLRNTLGLRSPIHSLVRLLNPLNADCILQSIFHPGYQETHREASRLLGDRAIVIKGEGGEIEVNPDVVAHLYGCDQGEAWDEEWPALSTHRHMKPEQLDPGFLRAVWDGREGDAYGHLAVLSSMALALRALGKNREEAFKEAAHYWATRNESI

SEQ ID NO: 31437 - protein, 313 aa, Pseudomonas aeruginosa
SIRIALYLYKFIDRPTLDCSSNDVWRNPLMGQLIDGRWHDQWYDTQKDGRFQRENAQRRHWLGEPAFPAEGGRYHLYVSLACPWAHRTLIVRKLKGLESLVDVSVVSWLMRENGWTFDPAHGSTGDRLDGLAFLHQRNTRDDPHYSGRVTVPLLWDKQAQKIVNNESADIVRIFNSAFDAIGANALDFYPEPLREEIERLNGRIYPAVNNGVYRAGFATRQDAYEEAFVQLFEELDYLEGLLGERRYLAGEYLTEADIRLFTTLVRFDAVYHGHFKCNLRRIEDYPNLSGWLRELYQRPGIGETVDFEHIKGH

SEQ ID NO: 31438 - protein, 117 aa, Pseudomonas aeruginosa
SDPAAPHVRRGACRRTGVRHRGGIIRGSTAPPGDRKAPRRPAASGAGHGTSAGPDPPARPRPDIPRPWLCARGLRPDALPGDARLPPDGRPGHARRSRPGTGFPRTPGAAAGRVAIP

SEQ ID NO: 31439 - protein, 365 aa, Pseudomonas aeruginosa
PCSAVCRLIMNCARARCRRAIGPRMRAKRAPESLAAVSKSSQPCRSPRATWSLTSKSKVFGVPQRRTSTLASSSAPTGTDSCGRLGMPSSMASSSPWMASSWRLPSSSSEPMRSTSASSGAMSSPRCLAWPIALERALRSACSCSVRVCTDLRCSSSASMRATSSWKPRVARRAATSCGWVRTSLGSSMLFSRLVSVIGGSWPGWRFAGPGDVIDAVAEAWLAPPSPYRSGFSALAGTGAIQLGQVFQLVADLQFQAPRHRLIVTPRLQILGEIILSGGIGIRLVVGVAVFLAIAEALHQFGRRVAQVQWHFPRAAFGDVAHRRVERAVHRIALRRTGQVDDGLGHRQLAFGAAQALLHVPGRQA

SEQ ID NO: 31440 - protein, 534 aa, Pseudomonas aeruginosa
AEGARIGVANLLAGHAHHPPGDVQGIAAAVEHTREPIKCRVGIGAAHRLVQRADLVVERLAALVETSAGIAEQILQQLGADLAAVLGEVGSVLQQVQQAPPIAVGGGQENLEALLRQPQLALAEALVLVQRAAHQLAQGGFVEALEDIHASPREQRIVQLEGRVLGGRANEDQRAVFHIGQEGILLALVEAVHLIDEQDGPAPVLRRVLLGHLDRLADLLDPGQHRGNGLEMGVRHLRQQPRQGSLADSRRAPEDHRVQRALLQRLAQGLAAGQQVFLPHILVQVCGPQPCRQGLRDGLAAEQIHGLRLLLDHVDARRNVEGELLGIQRLVHLHVEEQDVGALADAIDHLHVVHLAAAERQTQGVEEGVLGLRLEHEIDYVAAFLVGDGEAFADLRDVAGEQQRRRLGQALIELLDGHLLQVRVVQPDLLAVGNEQLLVRRIGMPAEQSRPLQAQLAGGFLQARAATVQGQLGKTRGQGLGLVQQAGQALDSGAVVGMGQRSAHGQGGNEQRADQSHRNPLKPVGFNHEPAPAR

SEQ ID NO: 31441 - protein, 199 aa, Pseudomonas aeruginosa
HSRQNSSGGSIGARIFLCDKGLWSLFMSEVKHSRLIILGSGPAGYTAAVYAARANLKPVVITGIQPGGQLTTTTEVDNWPGDVEGLTGPALMTRMQQHAERFDTEIVYDHIHTAELQQRPFTLKGDSGTYTCDALIIATGASAQYLGMSSEEAFMGKGVSACATCDGFSTATRWSAWSAAAIPPSRKRCTWPTSPRKST

SEQ ID NO: 31442 - protein, 332 aa, Pseudomonas aeruginosa
RAPSTAAPASYRWPACSSPSATSRTPTCSRANWKCATATCGSTAAAKAMPPRPASKACSPPATWPTTSTARPSLPPAPAAWPRWMPKNTSTTIDRTRGRPALPYPAMLTWLSRTDFDFPPLDKALQEPNGLLAAGGDLNPQRLVAAYRHGCFPWYQDGQPILWWSPDPRTVLFPDELHVSRSLAKCLRQQRFEVTFNRDFRAVIQACAAPRDYADGTWITTPMQLAYQELHLRGIAHSVEVWQERQLVGGLYGLAMGRLFFGESMFSRADNASKVGFVTLVRHLRDAGFVLIDCQMPTRHLHSLGARAISRGEFADYLQRYRDQPPTGDLDF

SEQ ID NO: 31443 - protein, 253 aa, Pseudomonas aeruginosa
ASFRAWHKLAYGSLLEFTMTELARLKFYATQPHPCSYLPDEQATTLFLDPSQPMDTQLYASLSEVGFRRSGDHLYRPHCQHCTACIAARIPVAGFSPNRQQRRILKRNAELQVIRKRPSFNEEYYDLYRRYIEQRHADGDMYPPSRDQFATFLVRDLPFCCFFEFRLHGRLLAIAVTDVLPNGLSAVYTFYDPDEEQRSLGRYAILWQIAETERLGLQAVYLGYWIKNCRKMNYKTQYRPIELFVNQRWVALT

SEQ ID NO: 31444 - protein, 73 aa, Pseudomonas aeruginosa
TTLSASRSGTWPSTMRLARPSAMAVLPTPASPTSSGLFLRRRARICATRSTSCSRPTSGSIRPWRASSLRLLA

SEQ ID NO: 31445 - protein, 163 aa, Pseudomonas aeruginosa
FTTSIRAMLCCLSRNTAWLSCSLKIATRTLAPVTSRLPELCTWNTARCRTRWKPSVGWVSRSSSCCGISGVVESMNSCRSRRSLSRLAPHARNTVAAASLSSKASSRCSTVMNSWRLALASLKARLRVTSSSRFNMASPRSQTSDQLSFSISQSNGCWLSRAY

SEQ ID NO: 31446 - protein, 142 aa, Pseudomonas aeruginosa
ACSAVRSSGSTTPRATGSSWPRAEMRTCSPITRPFRWTVTRHSRRASRSISRSSRDRRDCMPSTSAPPPRQPPHPPPPPRRKSRRRRPSKPDPSADAEMKKAGANRPFSRSGASPSYILAIIASPNSEQDSRVAPSIRRSKS

SEQ ID NO: 31447 - protein, 82 aa, Pseudomonas aeruginosa
VTVLAAIAPLVPLMIRSAASVQPMWRSIISAERISEPGLTLSWPAYFGAVPWVASNMATESDRLAPGAMPMPPTSAARASER

SEQ ID NO: 31448 - protein, 741 aa, Pseudomonas aeruginosa
MSIRSKITYTFTDEAPALATYSLLPIVKAFAASAGIDVETSDISLAGRILANFADRLEADQRIEDDLARLAALATSPDANIIKLPNISASVPQLKGAIAELQGLGYKVPDFPEDPQTDEEKEVRARYAKILGSAVNPVLREGNSDRRAPAAVKAYARKHPHSMGKWSMASRSHADYMRGGDFFSSEQSITMAKAGDVRIEFVGKDGKVEVKKQLSLQEGEVLDSMFMSCGKLRDFFEKTLQDCKETGVMWSLHVKATMMKISHPIVFGHAVSVYYKDVFDKWGQLFEELGVNPNNGISSVYDKIKSLPASQQEEILHDIHEVYSHRPEMAMVDSVKGITNLHIPSDVIVDASMPAMIRNSGQMWGKDGKQKDTKAVMPESTYARIYQEMINFCKTNGAFDPTTMGSVPNVGLMAQKAEEYGSHDKTFEMTADGTMRVVLADGSVLMQHDVETGDIWRACQTKDAPIRDWVKLAVTRARQSDTPAIFWLDPERAHDRELRKKVELYLKDHDLTGLDISIMGYNEAIRVSMERLIRGKDTISVTGNVLRDYLTDLFPIMELGTSAKMLSIVPLMAGGGMYETGAGGSAPKHVQQLVEENYLRWDSLGEFLALAVSLEETGIKTGNAKAKLLGKALDEATGKLLDNNKSPSRKVGDIDNRGSHFYLAMYWAQALAAQDEDAELKAHFAPLAKALTEQEATIVAELNAVQGKPAEIGGYYRSNPELTSKVMRPSATFNAAIDSLA

SEQ ID NO: 31449 - protein, 155 aa, Pseudomonas aeruginosa
  UNSURE (16),(17),(19),(20),(38),(47): Identity of amino acid at the above locations are unknown.
AGIPMCPVATIVEDQXXFXXVEEQADGREVLNQPAGHXEPAESLLEXALRETFEETGWEVELSAVTGIYLYTAPSNGVTYQRVCFAARPVRHHPERALDDGIIGPRWLSRDELAAQPQRWRSHLVLRCIDDYLAGGRYPLALIRDTHVSPSLPQA

SEQ ID NO: 31450 - protein, 495 aa, Pseudomonas aeruginosa
RVRALPCRVQGRPYAEPGHPLQPRNQVQGVPRLRADARRGPDRHRPLCAAPRPRRAHRAAQGPGPEQGPELLPARGGRRADRPQPVPRRRTGEAGSPRHRREAWPRHGEEEGLHGHLLHWRATLHRFPQAVPAGPAGRHRDHRRQGHRSPQRPDVPHHRPAPGPRHRRSQGSRRRSLVRARQGPATQRAAGRPGQRPPAAVLPRPAGLANLLGQPGRTGAAAPPAGQGALPPERPGLRPGENRRRLPRGVRRTAARGDPGAIGGVLRRRRLPRRRRDRNGGSLGFRRTPVSDPRQQLIALGAVFESAALVDKLARTGQISEAPLGCMLGSLLARNPASTLDVYGGDSLNLRDGFKALASALERKPGSLQREPLRYALAMLTLERQLDKRGDMLDLIGQRLDQVEQQVQHFGLVHENVIASFASIYQDTLSTFRQRIQVHGDMRHLQVSSNAARIRALLLAGIRSARLWRQLGGSRWQMVFSRRRLLNELYPLLRG

SEQ ID NO: 31451 - protein, 364 aa, Pseudomonas aeruginosa
YSPATSGRTDRCRIPPRLLAAQTAAGPPGDPGLRKPAVRRRAGRVVAGGVDGIAHRPRTRENPVGNAPWPVPGGGLPAPAGTGLDPAGAGGRPVRPGSRPTAGAIPLPAQLADRRRDDQLRRSRRRRRSALRQLRRIPASGPRTPALESRTDVQQRQPAARARRPAHPRRLRTERRVGPGARRHALPAPAPRPLRHCRRRVHDLLDRLPRAQRRRSADPFHRLPRPVPLRRGALHRCRPATGRRRSAPDPARRSGAPAGPDPGAHERRAPAADLVRPVHDRTALSRTGCRRGDPRRGAVRRPRGWRAAGAQPQRPPGLERDRHRPGAVRQRPERTPARAAQGTAEAGLLGRCVASGKPRPMAGR

SEQ ID NO: 31452 - protein, 266 aa, Pseudomonas aeruginosa
SPASAAARSWPAARRSAPSPSSASRSPPAPLPPKRRRPPRKACAACLSNAATACPSKPSPAAAPIPSGCPPATRRRPSYPGAPRSAAVIRDSSTTPATAPRTRPNRSACTTTACTSSRSTRSSASAADTSATMACWCSTMNTSTRRCCTPMARPWSMASAPSPMKCARKSTPMAFPSWRSVATCVASGMSYRRNAIGGSPPPRRCVSPARRAATNCCAPATVRTAPAPAAPTTTVPTVSPPGAPTSPARRTGSAISPPRTANCRAN

SEQ ID NO: 31453 - protein, 121 aa, Pseudomonas aeruginosa
PPSRRWRPDRSSRSGNRTRARSAWRCWSATRTATSRSPARWSGPGSARNPGTLPQPLGSAPPERLHLCCEANRRKPCPAPSHPSRRTAGAAPGGATAGLSWCGKKKNRHAPGPENIPGLMQ

SEQ ID NO: 31454 - protein, 154 aa, Pseudomonas aeruginosa
TCSSSLGIRCLPSKGRWPSRLHARGFVPAWQQGIWSQQERTLRIRDRPHRRRTPASLGKILSGRDALRDLRRRSPLPLRLVGVGSRKRLGRPDRGNHFHSNSVGGSCLSLADRCARLGSRKPSQAAGEAKTMRLWRCNTNLPGSIPMRPTTNTR

SEQ ID NO: 31455 - protein, 478 aa, Pseudomonas aeruginosa
RDDQGRLVRARPQPAHRHPYLAQRQLVRARSVGHVRHHLHRPPAPDPHADAADLAGPSAAQGLPGARHRVRSLLPVRRQAGPGPGALRFKPEDWGMKRHGRERGLHVPQPRPEPPVRPRRVPHHPAAGRRGDHRLRPGDRLPPPRRREDGRAPVLAQFHSLHRPHRLPRRGDEQPALRTLGGEARRDQGAAAGRRDPDHDGGVLPYPEPPAVPGHLYPGRRRHDPGVLHLHRPPARLQGGRGHHRLPPAPGLVPHRRRRPRPAARLGQAGPRVPRLDAQAPRRVRDRGPEEQHPARPDHRRRPVQHQGSPRVGHHRRRPARHRLRLRPAQGPPLLRLRELRVRGTAGPQRRRLRPLHGQDGRDAPEPADHRTVPEEHAGRPLQGRPSADHAAAERTHAATHRNPDHPLPAGFLGPGHAGQRSLPDDRGDQGYQQLLPDQRRQHHELPHAYPDAQLRAPATDPLGDQRQHDRGPDRLPG

SEQ ID NO: 31456 - protein, 102 aa, Pseudomonas aeruginosa
RSSRNSAAGCRTAPSRRSARCWGSRPATSKASPPSIVRYSASRWAATSSASATAWSATSAATSRWSARSRSNSASVSARLPPTDASPCSRSAAWATATRPRR

SEQ ID NO: 31457 - protein, 512 aa, Pseudomonas aeruginosa
STTTLMATCVPTVSPNCWRPTYDPYLHWSGQPHGAFGGNPSADLAPARRRPARLARGIPEQGRLCRGAQGADPDGPGRHRPDRQGLRPQGPRRRGLPHRREVGPDAEGRVAEHPLPAVQRGRDGAEHLEGPHAHGAAAAPAGGRHADFRARAEGLPRLHLPARRIRRRGAQPQPRHRRSQGRRPARQEHPRQRLRFRAVRPHRCRPLHLRRRDRADQLAGRPPRQPAFQTALPCRRRRLGQADLREQRGDAVQRAGHRRQRRGLVQDPGPPRQRRHGHQADGLLRQGEEPRPVGTAVRRQRPRAVRGLRRRHARRLPAQGLAARRRRYRLPAPGAPGCADVRRRHRQGRHPDGHRPGHGGGRQHQHGFPAAQHGRVLRPRVLRLVHPLPRWPAVEREAAACPGAGRRPARRPRDPRAAGQLPRPRQDLLRPRAGSRRAAGQRPQVFPCRIRGGHLPPAFGRAAPGNGRRLMLCSRTASRPAMFRRRAAARPQARRNREFLLATPADNGPTKT

SEQ ID NO: 31458 - protein, 906 aa, Pseudomonas aeruginosa
TMATIHVDGKTLEVDGADNLLQACLSLGLDIPYFCWHPALGSVGACRQCAVKQYTDENDKRGRLVMSCMTPATDNTWISIEDEEAKQFRASVVEWLMTNHPHDCPVCEEGGHCHLQDMTVMTGHNERRYRFTKRTHQNQELGPFIAHEMNRCIACYRCVRYYKDYAGGTDLGVYGAHDNVYFGRVEDGVLESEFSGNLTEVCPTGVFTDKTHSERYNRKWDMQFAPSICHGCSSGCNISPGERYGEIRRIENRYNGSVNHYFLCDRGRFGYGYVNREDRPRQPLLVLSKQKLSLDGALDQAAALLKERKVVGIGSPRASLESNFALRELVGEGNFYSGINEGELDRLRLILQVMQEGPLPVPSIRDIEDHDAVFVLGEDLTQTAARIALALRQSVKGKAVEMAADMKVQPWLDAAVKNIAQHAQNPLFIASVSATRLDDVAEETVHAAPDDLARLGFAVAHAIDPSAPSVADLDPQAQAFAQRIADALLAAKRPLVVSGNSLGNKALIEAAANIAKALKQREKNGSISLVVGEANSLGLALFGGDSVEAALERLTSGQADAVVVLENDLYRRTDTARVDAALAAAKVVIVADHQQTATTAKAHLVLPAASFAEGDGTLVSQEGRAQRFFQVFDPTYYDARNMVREGWRWLHAIHSTLQGKRVDWTQLDHVTEAVAEAKPILAGIRDAAPAASFRIKGLKLAREPHRYSGRTAMRANISVHEPRTPQDIDSAFAFSMEGYSGSQEDRQQIPFAWSPGWNSPQAWNKFQDEVGGHLRAGDPGVRLIEPKGEGLDWFQAVPVPFSAKADSWKVVPLYHLFGSEENSSRAAPIQQRIPETYVALSKEDADRLGVNDGATLGFQLKGQALRLPLRIDEQLGAGLIGLPVGFAGIPAAIAGCSVEGLQEAAQ

SEQ ID NO: 31459 - protein, 367 aa, Pseudomonas aeruginosa
PARSCWPRPSKENHRDQRNHQRRAWHLHPASQPGDDLRPCLPQARHPAIPRRAGLPAAALSWPDRPDPRPRRRGTLRSLQPVRRGLSGWLHLPAEGRDRGRSLVSGVLPHQLLALHLLRPVRGSLPDHRDPAHPGLRDGRVQAPGPGLREARPADLRAGQEPGLQLLPRCGDGDRRQAERRRAERSRTDQREKPAAIRRRRVEFAFYFAAGVAVLATLRVITNSNPVHALLYLIISLLAISMTFFSLGAPFAGALEIIVYAGAIMVLFVFVVMMLNLGPAVVEQERKWLTPGIWVGPSALALVLLVELLVVLARTPSGAGIGHTTVDAKAVGISLYGPYLLVVELASMLLLAALVAAYHLGRQDAKQ

SEQ ID NO: 31460 - protein, 117 aa, Pseudomonas aeruginosa
RFGGRPAPAPRERNAMNAIPLEHGLALASVLFALGLVGLMVRRNILFVLMSLEVMMNAAALAFVVAGSRWGQPDGQVMFILVLSLAAAEASIGLAILLQLYRRFHTLDIDAASEMRG

SEQ ID NO: 31461 - protein, 405 aa, Pseudomonas aeruginosa
PWRPWPWLGGAVGKSAQLPLQTWMADAMAGPTPVFRADPRRHHGDRRRLPDRPLPRPVHPGPGHPRTGRHRRRGDLGPGRLRRPGTDRYQAHPRLLDHEPDRLHVPRPRRRRLGRGDLPPDDPRLLQGPAVPCLGRGDRRLPPRAEHLQDGRLVEEAAAGLRQLRGRRCGAGRPALPHRGLLLQGRDPLGGLRQRPSRTADRRPGGCVPDLDLHLPPDLRRLPRRAEDRSPRRPRDFPLVAAQRADRPVDLRRRPDHPAAGWRPAGKRRPRRWRSQAQPGTGLGCHRHRRYPAGRPALPRPAPLRQRPGEERPGSLLRYLVVPRLGLRLAVRQAVRETLPAALPIAGARPHRPYPGRRSVQRARRTQPPQPHRERPPALVRRFPGGWSRHPARRAAAGLTNSRRD

SEQ ID NO: 31462 - protein, 207 aa, Pseudomonas aeruginosa
RQEDPHLRRHQVLHLHPGQRPGDAGGDPRPGVRQLQCHRRDHLRLRHPAEDPAEPPRGMAADARLLRRLRGEDAGGAGAFLAAGRPRPGAHRRLRGPRRHPPEDRRLRPDPLRPAAVPQRLGGIRADRHVARHHRHLLRCPAVLRADRHQAPGRLLQRFAHGLRDDRHLLRQPGRAAGRGGADDRPRPLRRGAVHPLRPALRAPAYP

SEQ ID NO: 31463 - protein, 109 aa, Pseudomonas aeruginosa
PSPTPTWKAIRVTAKSCTCSCCWPPPAAWCWSARSTWPACSSAWSCSRSRSTGWSPTPSSTSARWKPASSTPCSRPPGPPSCCSAWPCSTPSPVPWASPALAPRLPSTC

SEQ ID NO: 31464 - protein, 161 aa, Pseudomonas aeruginosa
SAPWCWAAPSACTTTCGSWSPCSWSSPASASTTHRSTGASAPAASCWWPSPCWRSSSASTRSRCWKSSSIPAWPSPAESPAPRKPRLGGVFLWPAPRTLPRCRGMLRAPWMNPEASCPPSTKSTSCDTTAPVGTPRPPVTANGRDRSAPKRSPPHAAATGR

SEQ ID NO: 31465 - protein, 346 aa, Pseudomonas aeruginosa
SAGGRGSFTTAGRLRRIMTGRLCGAPLPAGSFAGSGRAGEGSDAELTDQSAQALAQLRQAAGGLRALLGLVGDAVHRAGDLVHAAVDLLGHRGLFLGGAGDLRVHRVDGGDQLGDGIQRIAGLVGLVAGALAGLAGTAHGVDRGVGALLQAIDHALDFLGTLLGAAGQRPHFVGDHRKATSGLAGTGRLDGRVERQQVGLFGNGADHPEHTDDGLHVLLQAIQRSPAVADLVHQRVDALDAAVHHALGRLAFVVGLLRGLGGALGALRHFMGGGGHLVDRGGDLVGLVALALHGLLGTLGLGRHLLHQLLEVAGHPGDLPHQTVDLLDEAVEGTGQLAQLVVAGHR

SEQ ID NO: 31466 - protein, 177 aa, Pseudomonas aeruginosa
LCWPSTLSPEVGPRVESDAGEPASPSAPAVPTMLTMASGLKPSCTASGTKIAAMIGTVENDEPMPMVTSRPTSSISMAPTALLLPIQATEASTRLCTSPVAFITSAKPAAAIMMKPMVAIIFMPSVNRSSVSFQRTTPDSEKTTKPTSAPMIIESSHSCATNAATMDTPATARLFGL

SEQ ID NO: 31467 - protein, 206 aa, Pseudomonas aeruginosa
SSGGTSSGMKAIWIGRIFCEDTATQSSRPTRIHLNAPAPLPCSSCRPSSARTLSASAWATPERAMATAKAPSMAYDRATVAPPPRPPLKALRVPSRPRPPNSPPTTAPMISASTTCTRQRLRTSISPTASTTAFIVELLANETNSTVCGRKKGRTLLQPSPPVKAAHARMSPGYKPLCTVLACDSPNDGNPAPATGPSSRMGEPCR

SEQ ID NO: 31468 - protein, 137 aa, Pseudomonas aeruginosa
ATCRRSANRATANSMTASARSASSARPGCSPATAATPACSARTWPRRIRSTPANSCNCWPPARAGCSTRTTTSRCCNRCSRFPAPSPGACSSKCRRAPCSARPWRWSGNWTTCVAKAPGSNWASASAPRCSACWCCG

SEQ ID NO: 31469 - protein, 421 aa, Pseudomonas aeruginosa
PRRPPLLSLSTGLAQQEHQHRQHQRPAPAARTRPPFHRPRPPCKKPGMLGKAQEEILPGVSANGEELLSPGGAAALLQRQLDAHPQAAQRAVLETQAATAGLGDVARDAQAQAMAADLLVEPGTPLEHRLALVGEDTGAVIVDLQADHALALRDGQADFAIGPLAGVVQQIAEHLQQVLAVPWQAQPRWRAPAHLQVRAVDQAQGVAQRRQLLGAIEMCARQRFADQAGLAQLATEALLDLFQLFAQDLLQLRLARHLLALGEADQHRQRRLQGVTEVAQGVARTLQGLLGVRQQVVDLLHQRLQFLGSLVVQLATLALLQLGDLQAHLLQRTQRTTHGQALQQQYQEQRQGAGAQTHPLHTGEAFQDRRIVLRHHDPQLLAHALVVAAEHQQSLLLGPIDQALHQPFLVRHFQLAVPQGA

SEQ ID NO: 31470 - protein, 480 aa, Pseudomonas aeruginosa
RPPGAAAGRADRLPVALPAPGRRQPAPGAARLRLDPDGHGRRPRPAWRRPRHLPRRRPARLPSRPALRGPRRGALPALHRQGDPRLVRQGLALAPWRRRAPAGRAAAGAVARVPGAPAARQAAGPQGLHPLPRRRRRPRALLAPGDGGKPQARRRIPRTGRRRPARRTPASAGLSRHRREGSCMKLAVALIHGIGDQPDSRDEDGLHSYARELVAALRRRLGAEAGEVAFQSLYWASVLDARELDYLKRIEREPLGWRWLRRAVTLFLGDASGYRKVSAAYDTTYQQVHQHVRSGIMALRAKVGPQTPLVILAHSLGGHIVSNFIWDQQKLNRTPSCSIDPFLGLETLAGLVTFGCNIPLFTFAYEKVCPIRFPGHCLPPAIRQQARWLNVYAPADPLGYPLRPLQNYAAVVHEDLALPVGPWYKRHTPLSHMEYWNDARFHDYLADYLRRLLAAGLEPAGAGRALPAGEPGDRPLAELC

SEQ ID NO: 31471 - protein, 233 aa, Pseudomonas aeruginosa
LETRPPASRLTLMRYSRPLLAAEKRIVAAHFLAVDVQPQADVLSRLERQQRLAVHRLQVERGDFLALRLLACHAEAPHAAPAAIGLGAGGIHRLLGLDQQVGQLLVGRAPGFEDFVGGDLFAEDLADRPQQASADDRIVFGQHLQGDMLVHHLGHQRAEFLQLVDVPGVHQHAIGQRPRLVAAGLVGLVEQRANLGVLAEHGAVEMGDQRFTAGLQQRYGGFDEGTLGIGQHR

SEQ ID NO: 31472 - protein, 163 aa, Pseudomonas aeruginosa
LLTHARFCFTSKHFRKRAKANYQNSRALQAGIGHNDCNHSESLGLQRGRNDHQPLACHPDPAGCRPVPRPAGRRTLPPPAPGPARPAALRRHRAAAPGRRIPDPAGGGRPQPGHPRPALPGRRTSAPRGPPGAPRADPLPRRLRPARSLRRSGGRPPRPPGNP

SEQ ID NO: 31473 - protein, 507 aa, Pseudomonas aeruginosa
LPGLSAVPRRPALGLADPGYPRSVALRQRRPGYPGGLRQPRRRHGQGQRADARPDPPRRGRAPARRGLSRSRWRAATGNDRPERRAQGAAGRNPPGRQQRPERTDHRRDRGRQGTGGAIHPPAFHAQRQADDQSQLRRAARDPGGKRIVRPCARRLLRRGQRTARQVRTGRRRQPVPRRGRRVAAGGAGQAAPRAAERAVAAGRLRSRAPRRRTPDRSHQPRPGRGSACRALPRRSLPSPQRLSLARAAAARARPRYPPAGRLLPRGKPTAPGTAQPAPGPRGPGRAPRLSLAGQRARTRAPGRPRLAQGPRPQSGAVADRHPASAGSRPARGNPRATSQRGRARARRANDRSLVARGHRRLPTPPDPGLPGPPPGKLGLGCTRAGPGSRQPGAPGAPPATQVNDRPVGADRVRRANLLPWRPHSGCPITPIQSALQWNSSKNSPSNPPIACPTSPKATNAGACTATRSVSPSTSKVRSIRIPAGSATSRKSRRSSSRSTSNSTTII

SEQ ID NO: 31474 - protein, 136 aa, Pseudomonas aeruginosa
SHYKCTKTQHHIFRTGVKRMSKLAEFREAERKLQEQLALLEKLKSDSSLKQELEFKDKLQALMDKYGMTLHNIIAILDPKAPVTVSAAPQRRARALKVYKNPNNGEVVETKGGNHKVLKAWKEQYGSETVESWLQR

SEQ ID NO: 31475 - protein, 76 aa, Pseudomonas aeruginosa
PVSEDCTAISAVSRSRISPIMITSGSCRRIERKAAAKVRPMSAWTWTWVILGTWYSTGSSTLMSLRTPSLISSSAP

SEQ ID NO: 31476 - protein, 336 aa, Pseudomonas aeruginosa
TAGTTNAAKETAMPSRITLNANGGPEVLRLEQVQAQQPGPGEVWLEQAAIGVNPLDLGQRSGAVPIPLPSGLGLEGAGVVAALGPGVSGLAPGDRVAYATGPLGAYASARLYPAERLLKLPDTLAFEDAAALLFKGITAHYLLYATYPVGPGTRILLYGAAGAVGQLMAAWARHLGAWVIGVVSKAESVERARAAGCDEVLVFDAASLAAQVAELTAGRKVDVVYDPIGRATFEASLNSLRPRGLLVSFGATSGVPPAVEVATLNAKGSLFLTRPSLAAHTANPEEYRLRAQAVLRAHADGVIQPRVWRRYPLAEAAVAHTDLLEGRSQGALVLLP

SEQ ID NO: 31477 - protein, 443 aa, Pseudomonas aeruginosa
PMTRRPVPNRLVRFAFPFSHSNNNPMRNPGMGQYVSIAASDGSGRFDAYLALPASGKGPGVVIGQEIFGVNANMRAVADLYAEEGYVALVPDLFWRLQPGVDLGYDEAAFAKAIELFQRIDLDAAVDDIAACIEHLRQREEVVHAGIGFVGFCMGGKLAYLAATRTDVSCSVGYYGMGIEALLDEAKQIKGRLVLHFAEQDAYCPQQARDAILPCLRNLPKTELYLYPGVDHAFARVGGMHFDKPAYLMAHERSIAALKREIGPNFDLSALWDEHVRHEFDTRDVAATMATMVAEPYVNHVPTLTGGVGQRELSRFYRHHFIHGNPPDMTLTPISRTVGALQVVDEFVMRFTHSCEIDWLLPGVPPTGRFVEIPMLGVVRFRGDRLYHEHIYWDQAGVLVQIGLLDPQGLPVAGVESARKLLDESLPSNRLMARWAASEGLGL

SEQ ID NO: 31478 - protein, 182 aa, Pseudomonas aeruginosa
DCPNAGSGRHRRGSAAYRYARWRRCAANAGHRCRPPAPPRRSGRPAPARGSPGRSRRASRRRRGARRRRPADRLLRTVPWPRCPARPARRGDRRAGSGSGHGAAPGRGRSARDLPYSGHRALPARRSHGSPRSSPPARRPASRWSPGSPASAPRGRWPGRGCRRRTPPPRRHAAQRKTATAR

SEQ ID NO: 31479 - protein, 587 aa, Pseudomonas aeruginosa
SLRRALLFFVLQRAFDDLLARLPGGLGGHGLLDGIGMGGLARGQLGRAVGGVGRLSGKGPDRLGGLHHGLAGAEHARRHGADGRRGADVFPVDVDALPLDIGEVAIAVPVVLHLPQHLLAGLHPQLDAGAQRRSDRGAGGEGADHHQRDDQAGGIVRHRGRVQRIGIEVGATAQAERVLAGIAPGFRQVLTVAVVVKAAFFIVVLPLEADRLRTRLSFRRYRPPVVRNALPTQLATFVAQLQGGTEVIGVEKSDPRLAQRRHALRRQRLAFGGERLAQLQQLRGIGLAGLLQAQQRDETARFVNGGAQFPRKGFGALAIAVPAEAHLLLDTVAQHHLGDPSRQRVVAVARLQPRAVGVIARQMDQALRAVVGQAQALAVGADTLDQVAQRIEAIAVAGDPLHAVAGPARRAFAGLVRAHLGATETGAVQFVLGECLASVLARVLADALQAVAGGVVSVGAGRRASAPAGQQATAEVVFVAHRRILVVVDADQLSKSVVAIAALPVETAGQTQAAALQASQRRVLALLGEQRVILPVAAGVATHLTVQGIALEGQLDRTDQRAVQMTRAIGQPGDRRRVAVAAGLAHA

SEQ ID NO: 31480 - protein, 726 aa, Pseudomonas aeruginosa
RVVAVLDAVDPTVGMYLAFQAQVTDLVVRVAHLAIRPAGAGQAAVGQPAVTLDQGRCVLGGGNPDARQAAIAVVGIGGLATVGILAGDQFVSGVVAIALATTVEAGLFHQTVQQVVAELRLDAVLVGQGDQPAGFVVQVGQFAAAGVGNPRQQIAVPPGKQRGVPLGIGDTGLPPKGVVFIAQGAAVGQFQADQLPQRVVAAPGQLSQRVAAGDQTSFVVVVVTPDLAGTIGQRGQQAEAVPLQAPLAAARVDDSRRPVGQARVFVGVAGAAGRAAHRRRIAPFVALEGPAALHRVLQLDQQPGLFVDALAIARLARRLLLEHPPLAIAPAPRLPSQRIAHGDQAAEQVVVELATAAVGPDQRGPAPLPTLAGELVAFDAAEAVADLGGIAQVAEGTGQAARLDLLHDPPVRSMDIPLVANLQPTRFAVGDQHVLAPGEYPDHLAKTVAHGDQIAAVAELVAHQPVEPRALRIDVVRRRSVVAGQDHAEQTQAVVALARLAGLLVDQRIAAPGAVAHAGEQATSAPAELGAVAGAAEAGLQAPDTVGATLEMQVAVAGQHQHGALLRLQFGRHRRPAPAPGLRFAAARTAAAQPQLLAAGIMLGTGSQRRKADPAALGVDQHAGVFAQFQVHALARQPPAPAEPADTGVARQVATGEGEGVRRRQGEIDLFRQQLAAEHRVDRLAHQRHAGGHPVGQADRAAADVHGGRAGGDNPSRDFLADMGNR

SEQ ID NO: 31481 - protein, 206 aa, Pseudomonas aeruginosa
RSLPGRSAGSGSSPSSSPPRPGRRASSRSCSRWTGRGGPSGNAPSPGRTGRSRSPRPWARPPPRSAGRAPPAPGSTARGGKPGRRRYSPARSRTARRPRHYRSRRVPGLPGTRRQPPGIRGSGPGAGSCSGGTDGPPRYPWRIPAGELARTGSGSPRCGSVHSVRRPDSAHTRQGSRRAGSRPRHGRARHWSALPGGCRDAGSRSR

SEQ ID NO: 31482 - protein, 371 aa, Pseudomonas aeruginosa
ASRSSTGACCTAATRASTAVSTCTSATCGANSPRSPSVTCRSRRYAARATCWWRRNTPDAQAPAVMETGAAAGRLLPAADLADLHLGPVGGAQHLLPRPGRPQLPGGLRAAGGGCLAQRGCRGRRTLPQGTVGEGRYLGGAGRTAPGKPRQHAAKRRGVEPPDLHAQARLADEPAPAGRTAVRQHRVPPTSRAGPAGNPVTGAPAARRADPLDPPGHPRHSPDPAGRPARPAALSPPGGAAEPLARSRRRPARRRTGKHSPRRTAGGPPRRTGRAGPGPGAHGRAPAPESRPAAPAAAHPVPRTAHAAGAPAHRPRQRATAGTVAPAPGSRNRRHATTAGRHPRPRLDGHRAPATAHRAGAGAVGVGSAAR

SEQ ID NO: 31483 - protein, 310 aa, Pseudomonas aeruginosa
SLAFRCIARRSPMSSRALPAVPFLLLSSCLLANAVHAAGQGDGSVIELGEQTVVATAQEETKQAPGVSIITAEDIAKRPPSNDLSQIIRTMPGVNLTGNSSSGQRGNNRQIDIRGMGPENTLILVDGKPVSSRNSVRYGWRGERDSRGDTNWVPADQVERIEVIRGPAAARYGNGAAGGVVNIITKQAGAETHGNLSVYSNFPQHKAEGASERMSFGLNGPLTENLSYRVYGNIAKTDSDDWDINAGHESNRTGKQAGTLPAGREGVRNKDIDGLLSWRLTPEQTVEFEAGFSRQGNIYTGDTQNTNSNN

SEQ ID NO: 31484 - protein, 152 aa, Pseudomonas aeruginosa
DAWPTATHRCWSPSATARRCASTAPGVPSTTPPRVPARPISATRSTACPAVAPTPSSTCCATACARPWRRRRPWTPRDKPSGDTPTAACWCSTHCSPVPASSPATPRPARRCGGATGRSSANERGSNSACAESARNSCSGAAAPNRPARAAR

SEQ ID NO: 31485 - protein, 67 aa, Pseudomonas aeruginosa
PLRGYSPYRKPGIRAPLHPSTLHGILSRLRERVGVRENRPTLPPESAGRPLPAPRRGPPPAGRSTRH

SEQ ID NO: 31486 - protein, 179 aa, Pseudomonas aeruginosa
SRRRRPPRCCVPVNPASRAGHAGVPLGAGRLPTGRHRRQRRCRRHSPDATRRCRPPAPGGRSPVAPACPRHRGTPPTCRPRRCAARCPARNARRPRRTIRPAAPPCAARQARRNAGGCAARAAARAPRPRRRRGPGGRAGALRSARSTCRRIRHRRSGYVVSLGAPGGKGRDIRRKASP

SEQ ID NO: 31487 - protein, 410 aa, Pseudomonas aeruginosa
AWLTGRQTPAAAPGSTRATMDSAFPHARHAALVAFVDALGEPGGGQLAGDLRALQGDPRQHGAGQCLAGGAFGQGEDLAVQRAVGELRAVALLQRPADRRVAHVQALAEAAHGQFGGARRARAVADQIAIQRQRNPRDATHRALERGVATGIPAGVEVGEAVQRRRVVRRIAKQVGDAEIHAAAPAEHLAADAAVQRIGIAVRVLLGESDADLHRPAGVYRVEAAEQLAAHGHDGDEIVECLAQFLLRARRGQALAVGAAIGRLDIQRRADQERRHVQLAGTTLDLAGGDPAQAGHRRVDLVGGLLLGHRQHRTEILVAGVDLLGGKGRVDIAGPPLAIAHRGRHQADDLRPYFVGVGRRRLRRPRTAPGQRQEHEQPRYAATLAYCFHLRFPVPLRSGRPMATAEARAF

SEQ ID NO: 31488 - protein, 669 aa, Pseudomonas aeruginosa
PIPPRCQEHAMSHDPPSKDRRHFLTTSSVLGAAGVLWSALPFANAASLSPASNPGGSMTADLILHNGRFHTVDRDNPTATAVAIKDGKFLAVGNDADAMLHRGSATQVIDLQKRTVIPGLNDSHLHLIRGGLNYNLELRWEGVPSLADALRMLKNQAERTPSPQWVRVVGGWNEFQFAEKRMPTLEELNKAAPDTPVFVLHLYDRALLNRAALRVVGYTKDTPNPPGGEIVRDSSGEPTGMLIARPNAMILYATLAKGPKLPLEYQVNSTRQFMRELNRLGLTSAIDAGGGFQNYPDDYQVIRELADQGQLTVRIAYNLFTQKPKEELADFKNWTGSVKYGQGSDFFRHNGAGEMLVFSAADFEDFLEPRPDLPQTMEQELEPVVRHLVEQRWPFRLHATYDESISRMLDVFEKVDRDIPFNGLPWFFDHAETITPCNIERVRALGGGIAIQDRMAFQGEYFVDRYGAKAAEATPPIQRMLAEGVPVGAGTDATRVSSYNPWTSLYWLVSGRTVGGMALYPQGLPRETALQLFTHGSAWFSSEQGKKGQIKVGQLADLAALSADFFGVEEEAIKWIESVLTVVDGKVVYAAAEFDKLGPPAPPVLPDWSPVAKVPGHWRQGAPLTAQVHQCVGACAVHAHEHNRARHSNVPVSDFQGFWGAFGCSCFAF

SEQ ID NO: 31489 - protein, 451 aa, Pseudomonas aeruginosa
RTRAGPSRPASPGVFPMIRVRPVGRLALFLALGGTSPCHAATQEAKAPDYLEWRLLNRNYFLYNDYRRADAGRGYRKEWAHGLIADLESAYTPGRVGFGLDLHGFAGFKLDGGRGHAGTGLLPLDSSGDNASEYSDAGAALKLRLGESLLKVGEMTVETPVFDTSDKRLQPQYARGFFLQSDDLDRVRIQAGRFTAFKEQASSSGHGDFDGYGASTAGSAIGFAGASLAASDNLSGSLFAAQLDNVWRQVYLNMNLQRAAFSLDGNLYRTRDQGRSRAGAIDTLAYSLQLKYRVGAQGFSLAYQRVHGDTPFDFVGGDSIYLANSIKYADFNGPGERSWQARYDLDLAPFGLPGLSFMARYVSGRAIDGSHAPAGGAYNPLGADGRYRPLQGSGGKHWERDLDLRYLFASGPFKDLSLNVSHLSHRANAAQAGDDIDRLYLIVEYPLKGSL

SEQ ID NO: 31490 - protein, 203 aa, Pseudomonas aeruginosa
KYSRCLNSVLQAENSSSQTLTWASIEPPMSSSSNSFTVLRRSGRIWMLSSPASFAVWSMVPSMSSSSAAPSRANLRRRRRAILMLRVPSSTWSSRFLYSRWSQTLAALPWRLPASPTRMPSGLKPPEPNGLVPPVPIHLLPPAWRSFCSSRRFLNSSISLSRPPRDWICAFSSSVSRRSNSLRSHSSGISDLRWSSSFSRPLK

SEQ ID NO: 31491 - protein, 748 aa, Pseudomonas aeruginosa
TQTGHSVTECPATSRPAVPPASSAVVVARRRGTLETSVERLDERVAENPEERLERADVPLVDITAQVHTGCELVFALVLQHSLATADQRLPHRAEQVLVAILHVLPPVEHVHVAQQRLDVAIQLAALSLGLQHQVAGAGIEVELAIGAGEVVEPLQLDAGDPQAQVEVLEVAQRVEMRRHFQRRLAEYPRRAFETRRPLAPGVGHVGQVIDAGVERRGVQVHRRLRSEVAETQGAVHHPHLVEGDRQQLVQLLAPVGAGTGLRGVAVAAGIDEVELRTLEDHPRHYCVIIPERLPAHRQVDARRVEERHRHLAVVLDDAQPVDPIRAAPERQVDVGDVPTVVAHVGQLAVQVVAHQVRQRQVQRQQQQKQRRQAAQGNGIAFLHRYGPPGQWTRAARRWFERVWTRGRGRNRLIDLSPCDKDTIMSRIFADNAQSIGNTPLVQINRIAPRGVTILAKIEGRNPGYSVKCRIGANMIWDAEASGRLKSGMTLVEPTSGNTGIGLAFVAAARGYKLILTMPASMSLERRKVLKALGAELVLTEPAKGMKGAIQKAEELVAGDPGKYFMPQQFDNPANPAIHEKTTGPEIWNDTEGAVDVLVSGVGTGGTLTGVSRYIKNTRGKPILAVAVEPVTSPVISQTLAGEEVKPAPHKIQGIGAGFVPKNLDLSLVDRVEKIGDDEAKNMALRLMQEEGILCGISSGAAMAAAVRLAEEPNMQGKTIVVILPDSGERYLSSMLFDGLFSEQELTQ

SEQ ID NO: 31492 - protein, 482 aa, Pseudomonas aeruginosa
APAANQSVADAVVSRQDTYNNEDPHRFPHPPRPRLRQRRNPRRGQPEDLQLVRIHRSRNRGELRQGNRHPGHLRRLRQQRDPRRQADDRPIRLRRGIPVEPLHGQADPGRRPEEAGQVPAAQLEEPQPGAAQGPGGQRSGQPVRLPLPLGHHRHRLQPGEDQGGARRRRAAGLLGYILQARIHAETEQVRGGGAGQRPRAAAHHPQLPRPATPQPEGRRLQAGPGGAAEGAPVHPLLPLLEVRQRPGQRRDLHGGRFLRRHPAGRDPRQGGQQRRGSALLDAEGRLAAVVRHGLDAGRRARREGRLRLHELPAASRGDGRDQQPCALRQRQPGRRPAGGRRDQGRPGDLPAAGEDGQAVRPRVHAAEDRPRAHAHLEHGEDRQVKPGAGPVCRRAGVLAQGSPTGSSNPGRPAIVPLVVFIDRIASMNQRSHSSLPALPVATGEVGALQPCASLSCVSPPVVASPPPPPPGSAACPPPGVSP

SEQ ID NO: 31493 - protein, 324 aa, Pseudomonas aeruginosa
RPNSLPQPAASSAIRCRGVPSAAGPSPRHARLQGGRSMFALNKSALAGLASTSLFVLLWSSGAIASKWGLAHSSPFAFLVFRFGIALACLLPLAPLLRLRAPRSARERGKALLTGLVMLGIYPIFYIFSLKLQVTPGMMATILGVQPILTAVILERRQSPARLFGLLLGLAGLVLVVYQGIGLAGMSTAGILCALLALAGVTGGSIMQKGIRENPLGTLPLQYLAGLGLCLAFVPFQPFEFEWNAGFLVPALWMGVVVSVGATLLLYRLIAQGNLVNVTSLFYLVPAVTAIMDFMVFGNRLGWLSLLGMGLIVVGLMFVFRKAG

SEQ ID NO: 31494 - protein, 131 aa, Pseudomonas aeruginosa
TTARPLPAPASTGCRRWPPTACSRPCSTTRPGWSSPKPPTPKAGRPSPVPNSGSTCTSPNCCRNWPSSPTARHPTIRPTRSSSPPASGAATPAIPPCATPAGTAAGATAPCASARRTPRRWAAPTARCCAW

SEQ ID NO: 31495 - protein, 151 aa, Pseudomonas aeruginosa
PTAPSATSSPARPGTSTCRRAWNGWRRPPLRTPEPGRTIMTFVVLEECIRCKHTDCVEVCPVDCFYEGPNFLVIHPDECIDCALCEPECPVAAIRAEDEVPLGQRQFIALNGELAAHPNWTQITRKKPAPDDHDAWFGLPGKLAELDRNGA

SEQ ID NO: 31496 - protein, 174 aa, Pseudomonas aeruginosa
SRLEGQRVSRCDMKIGELAKLTGLATSRIRFYEASGLIRSQRKANGYRDYAADTVWILELVTGAQGAGFSLEEIARLLPSGDGAWQHGELLEGLRRKVAEIEALQRRLEQNKAQLLVAIESIENKPDGLQCTENTQRVLERLREEGPPQTVGRPRQTRSRASSPTPAEQRLSDA

SEQ ID NO: 31497 - protein, 253 aa, Pseudomonas aeruginosa
SDANPPGQPAETGCRRDHSPRKVNAMTKRILHVVTNVAHYADPTQPTGLWLSELTHAYEIFAARGYQQRLVSPRGGESPLEPRALGWPHADASAKAWLADETRLALLADTAAPEQVDAEAFDAIYFTGGHGVMWDFPDDAGLQHLTREIYQRGGIVSSVCHGYCGLLNTRLDDGRLLVAGRRLTGYSWIEEVLAGVARKVPYNVEEEMKRRGALYERSLLPFTSKVVVDGRLVTGQNPQSAKATAEQVAALLG

SEQ ID NO: 31498 - protein, 171 aa, Pseudomonas aeruginosa
TGGVDPARGDLAMNSKNTICLWYDSAALEAATFYAETFPDSAVLAVHRAPGDYPSGKEGDVLTVEFRVMGIPCLGLNGGPAFRHSEAFSFQVATDDQAETDRLWNAIVDNGGEESACGWCRDKWGISWQITPRVLSEAIASPDRAAARRAFEAMMTMGRIDIATIEKACKG

SEQ ID NO: 31499 - protein, 114 aa, Pseudomonas aeruginosa
KGSRRRRTQRRVTLFQQEKGGSMDELFEEHLEIAKALFAQRLPYWCDVFLRPADQAFNAYLNARGQASTYLVLEGFDPVYIPRGCDLDAVRATARARARLREAGLGEDALPVLL

SEQ ID NO: 31500 - protein, 674 aa, Pseudomonas aeruginosa
SAAGSRRRRRRSAGAAGATTVEQALRQAWHPELVAVFVVSGEVRVGDMALGAICCGHDTRCERLPMPGTALFEKPRWLRDLLRFLPLKSQFVLSGNIRDLQACEVVPGTVTAQSFNQTLCDALLDAGYAQVLAWDPLAGFRVLGRPGSEAGATPQVLLDLGLTPVDGAAPAGIDLLGATLQRLVNRSGEPIALIVDFASRLAVRNDALSAAEHQLFTQALVLSHQARSRPAGEQRKPFFNSVLWVVEKEGDLPDWLLVDNPRLRHIPVSKPDQPARRALAPALLRGLGGAGVAEEALQQAAATFVENTEGLLLLDLNAIVQLARVEGLAMERIADAVRRYKVGVTEDPWLKIDRQRIRQADEIVRRRVKGQQHAVTHMLDIVKRAMTGVGASRKGNRPRGVAFLAGPTGVGKTELAKTVTSLLFGDESAYIRFDMSEFSAEHADQRLIGAPPGYVGYDVGGELTNAIREKPFSVVLFDEIEKAHPRILDKFLQILDDGVLTSGRGDRVYFSEALIVCTSNLGIYRQGENGERVANVLPGEPFEAVQGKVHGEIERYFKLVLNRPEILNRIGENIIVFDFIRADVAEQIFTQMVDGTFADLREQRLVIELAEAPRQALHDLCLGDLSNGGRGIRNQLEARLLNPLSRALFDQDAQPGERFLISALDADGLTLERR

SEQ ID NO: 31501 - protein, 146 aa, Pseudomonas aeruginosa
HPLPRLHLRRYLGAGTAAHRPGTPARRHPAMAGAGRGHHRLRRRTLRAVRCPPRPARRTAPAQPRRHPGLQRLPAGASARATGTGRRADRRADQRPLPTARRTEPGPARQRQPAPEPAHRTRPRAPRRLPAATARRRQGPRPDVRP

SEQ ID NO: 31502 - protein, 2108 aa, Pseudomonas aeruginosa
RQRPSAALNGSIPMIRFCPNCQSERSLSEIFCEGSIQGQPCGWDLSAEAIHPAGWRPQPVLTQEAIAPPASEPPAASAPLCANGHPLQPGDLMCLECGAAPAEGPLPMQAEATPQPAVTETLIDGWRLLRQIASSDGVRERYLAEHAEGARQAVLTLYRPGAEPDPAIYDVIRRLPREHVPEILATGRWDERAYEVVEELTGGSLADLGTVLEDREAVRHVVRELGHALHVFNEAGLRHRDLRPASLLVRSHEPLDLVISGFGSARLSEFDLDIVSPLETSRYMAPEAIAGGVAAASDWWSLGMILLEQLTRGSCFEGVNANAFLIHVLANGVALPDDLDPQLHLLLRGLLARDRHQRWQWPQVQAWLNGEAVDAPASADSEKDDAEGASIALGARRFRKPTVFALAAAQAEHWAEALDHLLRGAIVTWAEHIGLSPRLLAGLRQVAQHEGLEDDFRLMLALKLLNPEIPLIQRGEIVTPGWLLEHPLEGYRLISGSVPDLLEQLHTESWLSRLKTRAENVRQRALHQHIELAEEQLRIYLLSTSRARLAAQWQERQRLLPDTEHPGLLALAERRVIAEEDLIVLLSANIGQFRAAEAIVEEAAGLARDADVHLFDAETARGLLQHSRQELYRRVDERISGFARSGVPRVDEWAEQFRLERRMPLARVLVLLAIPPEQWLEPQKQQYVSQILDFFEKKVVAAVMRGPLVRMSIGKSTPRIDLNELHSARRPAAALLDHLLQRNARAVSLDPDSFLANPQLEVRLNALSRQSSLYKRDTGIDGLYLGFPFLLNRDPRGTTRTRIVPLLLWPLKLQLEVGSRGQVALAFDGEREEVRLNPALESLLGPEPCKRWRKVADELLGRSALRAADVMDAFGLLATPRARVLEGLPPSSTEVTPYQDQLACAAVLFHVTFMGQAIGEDLRQLKSLPPSGTGLETALRLRENGEPEARESPPELQRYFTVASDPSQEAAVLQARQSPGLLVEGPPGTGKSQTIVNMVADAIGRQRSLLIVCQKHAALEVVHKRLVAEGLGQRIVMLNDVNRDREPVIRNIREQLEALFAEAGGAQGWERQRERLAARIEALEGELDRYHQSLHRVDEATGLSYRRLLGELIELEKGSPPLDFPALRQRLAALDIGSLARLEENCAPLVRLWLPARYEGSPLAQLRAFATDQATLHAFADSLRAFGEAENARQKALDEHPASFEVDDPTPYRAWLASQVGTLLNLREEQRQRLAHWLPLFRDATPGQPSRGDGLLAEAEQIERQLRQLDLERHAPLLSPALAMLEENNLERFQAHARQVLEARTWLARLNPLRLLRRGRLRRFLREHGEADDDSRLAALLGACDLERQWRPLRRQLAALQQSLGLATVATDAGPELTGLAGHASQQLREIQVLARGLAQAPRAEQLDAVILTGEKQRFEALLGDLDAALIRQAARQLSLDKLKVLADWLGDELLEQLHRAIAGNQSNLPALGRLREALPQLVAYQRFRGRAGQLEATDLEFLALLRQRQERLDAIPAEELEATVRRMLNREARLGWKQRLEQDNPELLFSQDEARARVASLAEADVQMRALNRELLGKGIGAARLGSRKQWEDVTRLTGKRSRRLREFIELGAELGLMSLRPVWLMNPDLASRVLPLKAGLFDMVIYDEASQMPVEFALPTLYRGRVTVVSGDEKQMPPTAFFSSRVESDEAELFDGEAPDEDADEEQREAYEDTWNRREIKDCPDLLQLARNALPSTTLQIHYRSAYRELIGFSNASFYGNRLSVPVRHPQANILRIKPLELIQVNGLYQNQSNEREAERVVDYLAELWRQPYAARPSVGVVTFNRKQADLIEERLELRAEQDETFRAAYSEERERSEDGEDMGVFVKNVENVQGDVIVFSSTFGRNGQGSFRRNFGVLGQTGGERRLNVAVTRARRKVVMITSMPIGDISDMLGTQRSPSSPRDYLQGYLEYARALSAGEFAGTGQLLERLHTDRSDQRRQHYQRHDGFSEIVGEYIRSLGWSAAPAGEGDAFGLDFAIENPATGLYAIGIECDAPCHPLLERARAREIWRPSVLRRAIPHLHRVSSQGWYHDGDNERARLRAAIEKALAPSAETHPTAAAEASQ

SEQ ID NO: 31503 - protein, 442 aa, Pseudomonas aeruginosa
ESSPGKKPSPPASATCNAWTRPSRAGKTRPAGSPSSATPSAPPPTPAAPACTPWLEQERWLDVQLQVKIESEFLKRDLAEREERAIRQAAESRQQHRRLQENASALLQALDAKPDAASAAVRQTLQALADGALRDDAEALLAQGFAALASAPAEERLSEAQHELAQRLKTDETPITLEQWRARQQQDAPREQRLARIDRHIAELQLLQGEASAQAFLERLARAEAEQRPERRNLLLDSLVLDLAQAAREHQQQRQRLEHLQDLASEVAALGAAEHAELLQRAAACQPDRDPQQLAELTERCNAILTAHLQQQAALARRQAVLQGLASLGYEVREGMATAWAQTGRVVLRKPATPGYGLEVGGKADNGRLQLRAVALNANRDSQRDRDIETLWCGEFQRLQALLAAQGGELSVERALGVGEVALKEIGEEEQQEMGVVRQRGL

SEQ ID NO: 31504 - protein, 106 aa, Pseudomonas aeruginosa
ERCLMSKQRRTFSAEFKREAAALVLDQGYSHIDACRSLGGGGFGLAPVDETAPAGARWRDPEEQGAHPRTAEDPGAGGSDQPAGAAESDPKKATALLMSDELDRTR

SEQ ID NO: 31505 - protein, 96 aa, Pseudomonas aeruginosa; identical to SEQ ID NO: 19149

SEQ ID NO: 31506 - protein, 64 aa, Pseudomonas aeruginosa; identical to SEQ ID NO: 19150

SEQ ID NO: 31507 - protein, 164 aa, Pseudomonas aeruginosa
ITGLTFQHGGLGIQHFGTQPVWLRGGFGLFAFGFEIHLPGEFVFHAVGKVVGLTAPPVPLGFEFFQPDGFGFGIALVARRIGVLVEPDGVGVKVLGTIIHGAALGEEQQVGLDGGVRSEHPLGKTDDGVQLAVTQQQFFQRAFDAIAKQKTIGQHHGSAAVLFQ

SEQ ID NO: 31508 - protein, 146 aa, Pseudomonas aeruginosa
VFNGAFVFGTGFDAELIAEVVDGGGQKAAGTAGRVHHSFALVQTRIDAVGHEGSNCTRGVELTRVSSAAQVVKHLLVDVTQVGAGFEIMEVDGLVQLFDHGEHLRAGFHVVVGIAENFTDDLVLGAAVGVYLIFECRKQLIVDEAD

SEQ ID NO: 31509 - protein, 67 aa, Pseudomonas aeruginosa
CCSQPAFCMAGVMSFVQMSRSEYCAPSMTTPKELYPFNRDYRAENLNWQPIGNQSGAFLSTTQNSQA

SEQ ID NO: 31510 - protein, 98 aa, Pseudomonas aeruginosa
HADFFGSCRMLSRLFVGLFALLLASTGQANAPRTFSEAKKIGWKLYARQSVEFYCGCRYSGNRVDLASCGYKPRKNANRARRIEWEHVKYADCNMLQI

SEQ ID NO: 31511 - protein, 122 aa, Pseudomonas aeruginosa
SRLRDSITGRFRLNGNREVSMEIKSQALVDVVEDVICDVCRSGTSIPGYGPQYGKLEAQWGYGSQHDGEHYRVHLCEPCFFRVLSGLRRERTVNGMFDNDQPFAFEDFGLVSKDNYWGKNWL

SEQ ID NO: 31512 - protein, 210 aa, Pseudomonas aeruginosa
KSPRNSGAFPPFGLADAHAVSFSQRLQAASKTLADRLELELVVVTVQFAEDHGGLGGGVFGQVEASNLFAVGFVQDTDVGISHLAERLLTSFGVMDGDGEDQLLHVCAQAVQFDVDLLVVAIALTGAVVAQMLDGAVSARLVVVENEAGVVENFTVFASDENGGIEIELGAVSYARIPAQAHDDLGQTWCFFGQTDVAALLERNCHNVIP

SEQ ID NO: 31513 - protein, 155 aa, Pseudomonas aeruginosa
LLAAHKEVMTVQLRPYREELFREAVGKMLGVVLLFIIIVTALEHHHSGPGNDQREDDLDPGAKCEQAGTDDHEYATEDDSADDAPIENSVTEAIRYLEPGEDGHEDEQVVDRQHFLQGVAGDEQAGDFSAVLHVEETCERQRNRHPEHGPDRGAR

SEQ ID NO: 31514 - protein, 100 aa, Pseudomonas aeruginosa
VGQMERDTKPETVAPKIPDGITQSSAEAASHARPQGSANTTSRGSSGKRLSAPSVRLSSPEIAPLPVQPSTKTMFSAPCNWMIASRATVSIPRSRIMLTP

SEQ ID NO: 31515 - protein, 82 aa, Pseudomonas aeruginosa
VPNLTKCGEMVSNFKSDYISSCHWHRNGYGFHPDVRYPITHRLSQTKPSSGEDTWQVHSRMSGVADATGVPRIDLEQMWDTV

SEQ ID NO: 31516 - protein, 269 aa, Pseudomonas aeruginosa
AADAKYRAGAAALSDRLQAQTALSQASFAQVRDEGALSNAFGVIALRMGLAPDTPLRLSGELEAQPDTGFVKAIDEMLAEARREHPALLAAQARLKAAAASVEESRAAGRPSLALSANLARSHSDQAMAFNGDTRERDRSIGLQLNIPLFEGFERTYQVRNALARREASEAELADTEQQVSLEVWNNYQSLSVETRSLARTRELVEQSRQSLEVVQGRYRSGVGSMIELLNALTAYASAEDQHIRALGNWQTSRLRLAASLGRLGLQMI

SEQ ID NO: 31517 - protein, 407 aa, Pseudomonas aeruginosa
RRTGEERRPAVPDRPAPVRGRGQAPRSPGATGPRGPGAERQRSPARRTPARQQRDLRGIRRRPHHRRPGSQGGGRRDPGATGRGAPEPELHPDHRADRRSRQPRRGHRRQPGQLRGNPAHHPGQHRQGLRLLRRRRTRVPQVRRAGPPGRSRHAQREPGLPRPEQRGRQPAPGPAGLPRQPGQPAYRHHPRPRRVRQRQGRVHPGPQRAPEVGRQQDLRRHPDQGRSGRHRPGQEVRAGPGWRQQDRLPHRRDGTEAGGPAHRPQRPEQGRPDRREWPAAGPPGHAGGSAEGRDGQRRHPGHPRAPAAVGRRQRTTEGGGVQGQRHSQLAARLSAAIGRTDEFLPILHPAADLRRGAVAADPDWRRHLPVPATHQRIPGSGAADRRGPRQLPRRQPESHRRDRRLSP

SEQ ID NO: 31518 - protein, 80 aa, Pseudomonas aeruginosa
TGDHRGGEHALHVLPVDLRRQADPDHHLRPRHRPGQRPGAGAEPRHPDRAEAPGRSDPARHHRRQGLARPDHGRAPDLAG

SEQ ID NO: 31519 - protein, 570 aa, Pseudomonas aeruginosa
PLRHALPVELRGAQREGRTGPPRRRRRRPVVRPRRLFAARLAGPEQGRLAQPHRHRRGQRHPRAEPPGRRRHPGRAAGAERYQLPVVDQHPGSPGHRGRVREHHHPRRRQRRDHPSARHRPGRAGLQPVRPALAAEQQAGGGDPDLPASRLERHRDLQPGAGEDGRAEAQLPARHGLLHRLRPDHLRPRLHRGGGAHPVRSPGAGGAGGDPVPADLARLDHPAGRGAGVADRHLRGDAHARLLAQRAVAVRPGAGHRHRGGRRHRGGGERRAQHRPRPQAGGSHQACHARGDRADHRHGAGALRGVHPDRVHLRPHRAVLPPVRPDHRDLHGDLGVQLADPVASAGGGPAQGPPRAEGPLLGVPRQAPRQLAVPSVQPFLRPRQPWLRRHGEPGPARQLDRPAGLRRTDGADLLRLLQHADRFRPAAGQAVPGGLRPVARRGQPGPYRGGDQADVRDRPGAARRGGLGGLPRPVDQRLHQQPEQRHRVHPAEAVRRAQGPEPVGRGHRRRAERQVRRHPGRLHRDLPAAAGTGAGDHRRLPPADRGPWQPGLRGAVQADPEHHHQGPCAA

SEQ ID NO: 31520 - protein, 814 aa, Pseudomonas aeruginosa
AGTQLGVLQLPGQRAADRRRHRPREGQDPRRGDQRHLRHPAGLPRLAVRERLQPLRPYLSGQRPGRAAVPPRTRADRPAEGAQQPRRDGPAGVLHQGQRHLRSGPCDALQRLHHRRTQRRPGRGLQLRPGAGGDREAAEGGTAQRHDLRVDRADLPADPRRQYRAVRLPALRAAGLPRAGRPVRELEPAAGGDPDRADDPAVGDHRGDPGRQRQQHLYPDRPDRSGGAGVQERDPDRRVRQGQAGGRHGPRRRGAGSLPPAPAADPDDVHRLHHGRGAAGDLHRRRRRDAPCDGRGGVLRDDRGDLLRPAADAGVLRPHPPLRGEPRSAPRRQRQRPARGACMIHAQSIRSGLASALGLFSLLALSACTVGPDYRTPDTAAAKIDATASKPYDRSRFESLWWKQFDDPTLNQLVEQSLSGNRDLRVAFARLRAARALRDDVANDRFPVVTSRASADIGKGQQPGVTEDRVNSERYDLGLDSAWELDLFGRIRRQLESSDALSEAAEADLQQLQVSLIAELVDAYGQLRGAQLREKIALSNLENQKESRQLTEQLRDAGVGAELDVLRADARLAATAASVPQLQAEAERARHRIATLLGQRPEELTVDLSPRDLPAITKALPIGDPGELLRRRPDIRAAERRLAASTADVGVATADLFPRVSLSGFLGFTAGRGSQIGSSAARAWSVGPSISWAAFDLGSVRARLRGAKADADAALASYEQQVLLALEESANAFSDYGKRQERLVSLVRQSEASRAAAQQAAIRYREGTTDFLVLLDAEREQLSAEDAQAQAEVELYRGIVAIYRSLGGGWQPSA

SEQ ID NO: 31521 - protein, 555 aa, Pseudomonas aeruginosa
NLHARGHRPRPRQRRGRRPPVRRRAGARRAGPGPRRQPDPRDPRSQCPRRTAGDPPGQSGARQPASGRLCDLRQRPSLPDVSGRHASLRHPGGLVRLFQRGRRSVRPVHCHALRRDGAPATAAEPAATRPASCRRRGSVPAMAATPGMSARIPSGGQAASGVGAAEVSWVGLLVIFCLGINLRPILTGIGPLLEEITAGTGLGFQGASLLTVLPVLCMGLVALLLPWLGRWLAEHRGIVCGLLAIAAACLWRLELDSGLALIASAALAGSGVAIIQALVPGVVKRWFPRRVPAAMGLYSASLMAGGGTAAVLSPRIAEHFSNWQAGLGAWAVPALLALLLWMFARPREVLPSAGEGPVRHFFGNRRGWLLAVYFGLINGGYTSMVAWLPVYYRQLGWSAQDSGGLVGIMTIFQVLAALSVPLLIRRRLDRRPWLLAALLVQLGGFCGLLLMPLQHAALWVALIGYGLGACFALSLTLTLDHLHEPRAAGSLAAFVQGIGFIITGIVPYLTGWLRDVTGSFQASWLLLAASVVAMLLVTLRFAPSGYARAMGETRD

SEQ ID NO: 31522 - protein, 363 aa, Pseudomonas aeruginosa
ASQARRGSVASQAGRRWKRLAAIRSSSRPSQAAMLSGKASRRLPASISFCNGRRPSSSGSVAIRLSVRISQRSAGGRAAAGTRSMRLDLKPTMLSAGQSPTAAGNSSKSLAEQNSTLRRCSRPRSSGRLSRALPLRLSTSRESASSKISRGNSRRPQDRSRRVAPASSPLRSCCKVCMVRRTPARADGKPRMIAKALRNAHPRRARVAAPNRQDHREWNSPPPNANSCWPIAWPCSTAAWCTTPNRRCPPNTSSVLPKAWPDRFQKTCYASGAPVSAGASAMTWKSTTTATATRSLSANCSIRTATATTTSGAGSNTSASWRRKPRQKKAATGTASWPTCRSVASSTWSGSTSASNPAPSMAR

SEQ ID NO: 31523 - protein, 97 aa, Pseudomonas aeruginosa
SVRSYSLLKRDEYLAPATSQPERFAMKIIPMLLAALLATGAATTQAQDGSERSWQYNAEFRAAQKELREKRLQKQQLEAQAQKTDRSKCAERKNGNG

SEQ ID NO: 31524 - protein, 243 aa, Pseudomonas aeruginosa
STRGFGSRLGSFSGVHQGCGRVFDGSLLKARSIPSGFRRRFGQASIAFFTGVQYHLPLEPYPGGIMELRHLRYFQALARTLNFTRAAEQLHIAQPPLSRQIQQLEEMLGVALLERGRPLRLTEAGRFFHEQSATLLDQLESICDSTRRIGPGPAPVVRHRLRALGAVWRAAGADPPPARRPGAGAGPAGDDHPATGRGAEERAYRHRFRTHPASTTRRSARACSAKSRWSPPCPPGTRCSASR

SEQ ID NO: 31525 - protein, 849 aa, Pseudomonas aeruginosa
PHERRTAVPRRTVPLPPRRTLRCPGLGRLPRAVRRTVRVPPAAVGVRAALHPRSEARDVADLLPQPCRPGRPGVPYPHRQGRVHRADAAHPAPDRQRAHRRGRRRPAASAGQLADPVPAPGPDRQLLRPCHLPPETPWRGLADRAQAHRPAQRPDRLGPRLLPPLNGGPRHDESQSRPQLRRRQDPVPARRPRRPAPRRRPAPRHQPAAGLPRRGLRHLHGPLRGGQLQPGLRRRGHPLRRRPGAAQGARLPDPGALRRGLLLRLRLDPLPRRRGPGAQRRGARTAPALRGHRAAPPRRRRRGPPVGLPARPVRAPASTRQRLPARLLLRQPAESAEPPAVPHPPAPGRRHERLPAPRLPGRRRDPLRGAAGHLLPASGGAPVAAGGRRHRPVCVPRHARRTGRARLRSGGASLLRGTPRRRSLRIAADRRLRRAASRLPLRPGAQPRRTPTGTAGAATCTSISTPPACATKLSTSTCAGRRRWSRRSASGLRERSLGASTAVPGEVHRKRRLMRSAEVAASYRQGHAGDVGRLVGGEEKDRRDLLVDAAVALHQAAVEGLLDDLSIPAPLLLALRRGVARNPSRRRVGAARRHRVDADALVGGLERQAGGQRVHPALGGAIGHPVDPAGGNRRDVDDRPAALPQHRRQRRSATPQGGQQRTPQLGLNLVLGVVLVGLRPKGAADVVDQDVQPAETLQGPLQYPLAFGIALQVGGQAQAGVTGQFVDQLGAVHRHHPRAFLQQAPDHAQADTLGGAADQGDLVAESVVHGNLLGSLGFRPRWRRTFRSRNSPGARPARAGSARPPRPSAAARTGRCRRRPRAGAARRCARSRSPCADSRCRRWPRTRSR

SEQ ID NO: 31526 - protein, 493 aa, Pseudomonas aeruginosa
RHLPQRHALRPFALQGGEQRLLPVAMLQYEQPFVLGAHAAQARPQVDGRGRRVGALYPVFGAARQVVPADHAALVALLAGTELLQVVRGGHAADVEEVLVLADAPGARLGALAFRRDAVDGDFRAVHRQRPGDADLRAELVHQVHVGVQAEVARVLDHPVGAGLAEVAGKLGAALEGRPVLGVGPATPEQHVAMLERVEAAALPGPARGAHGPQRVRGVALLALALGRRVVPVHRADVVAVGAVLGGELPVAFVDIAGRAAQHLEAFRRLVDDHVDDLRRLAQVLGQRPDIGVEAAEQEATVGLEARHPGQVVRALAVEALRVAGLGRVLDLEQLAGVVEGPAVERTGIAAAIAALVPAEHRATVAAGVDEGVELAVAVARDDDRLAADLGGQVVVDSGNLAFVGEIDPVALEDVLHLQFEQAWIGEHLPLAAVDAALGVFLEQRTQVIATQGHGRGLRCYCSGPVRLGSACCWGYPLPADRWPIPARRGGRR

SEQ ID NO: 31527 - protein, 112 aa, Pseudomonas aeruginosa
PCLPAISLRRAVKACGSAIPALATRPSPLALNSRSSTSPVARSTSAPRTTSCGASALPPRSTQALSGLPSSGTSSSRVRSPWRNNMPPRGPLPSPSAAASPAPAGAFPPSSR

SEQ ID NO: 31528 - protein, 450 aa, Pseudomonas aeruginosa
APPPRPSSASAVTAIIVFLPILFSRTVRGARRRPAPEISLAEVADVFAEQALHAHPRLCRGVQRAHVLGTDADQGALGIEHVEEVELAHLEAAGHRVQRALCAGQQVATDQRQLLFRGAQLVVGLYRFAAQAQQGRALQVAGLVGAALGGVDVALVAVEQRQRHRQADQVDPFATSVAGGLVVLAADADRQVGDALALLQVDLGLAARDLLGRQAQGRRLVEMAQQGATGDARRHRVERAADPGEAWLRLVPGARQLHIGALLLQLRLAQVELGVVRQDLGANPFHRGDAAGLDPSVGGLQRAPGQVQGGLRQAHPLLRGQRRVVGAADLGAQFGATDFQLGPGDLAAAFRHLHPRTALAAQLQRLGDADAGLAIALAGVLDAPGQIRVGDQPGLLPRAAGDLGLAPHRRQLGVAPQGPLQRLLEADRSAVETHRRFVRQGRQAQAESHQ

SEQ ID NO: 31529 - protein, 585 aa, Pseudomonas aeruginosa
SIPFAASATSWKRADDATRPTVAAPGPAGRRPRRAAGPGARRNGALEPRPRAGSPRAGKPAIEAGADPPQPGRRSRPAQRPGRTGACPAGPTGGSQRPAPEHSRQPQRPAADELRRPGRGQRRGQPRASRPLAGGCPPAGVPELEHRQRPAPAEHRRFHAHEERHPGTGVAEQRAQRRRAPARRFPPRHPAGPALPPAIDRPDRLVGGACRPRTVEPLPPGGRPGQPAGSLLPHPRAEPAARAGQPGPQLQPHARPPRGWRTPALAVLRRPGPRTARADLQPAGAQPGAAQPASRRRGIPRSPGVQCRGTGAAVADRHRHAVPGAGGQPGDPGPVRLRRPARAGGQGHRPVRDGRRGQGRRTAPVRQRLRPRRQPDDPARHFQPGVQRRAPHPARRAHRRADRGTRGAHRGEGQQRRSGHPAGVPAAPVRALLPPRRTPDWSPGRHRPGTGHRAIDHGLPRRPRRSGKRTAAEDPPAPAVPFDGRCLTPVSATGAAPPQPVLAAETGEEQRQAERQQGPGRPQRGALERRFTVQQDEALQQRPEHRSDAAKHGQAAQPAEPVASARGHFRKLPRHVFTSTSATAL

SEQ ID NO: 31530 - protein, 1066 aa, Pseudomonas aeruginosa
GCLQRTVRAYAAFLVDPVAQAVEIEVDHRGGVQGQQLAADQPADDGDAQRPAQRGVAADAEDQRQGAEQGGQGGHHDRPEAHHAGLEDRLARAQAVVALGLQGEVDHHDRVLLDDADQQDDADQRDQAQLTAAEDQREQRADPGRRQGREDGQRVHVALVEDAEDDVHRQQRQEDQPGHLVLRVLHRAGVALEAGLHVHRDVQRLQGLHDGLAGRADLRARRQVEGQRGGGELALVVDLQRCPARFVVAERGQRHALAVVADHLDLAEDLRALLVLLVDLHHHPILVQRVEDGRHLALAEGVVEHRVDHSHVDPQGRRAVAVDHQAGLHALVLGVAVDVHQLRQLAHRRLDLRRPFAEQGQVVAAQGEFVLRVAVAAAQAHVLAGVEIERRAGHLGDPLAQPGEDLLHRVAFADRLEGDEERTGVARLPAAAADEADHVFHRRIGREDLAVLAHLRAQGLERDALVGHRVTAQAPGVLLREEALGHHHEQPEVHGDASQHDHHHQPRVLQRPAQAGAVAQHEGGEEAIAAPRLGSAFGPFQRTQYTRAEHRREGQGYHQGHQDRRRESHRELAEQPPGEAAHEQQRDEHRDQRERHRQHGETDLAGTGDRRLDRRIALLDASGDVLHHHDGVVHHEAGGDDQRHQRQVVQAEVAQVHDREGADQRDRHRQAGDQRGAAVAQEQEDHQDHQRHRDQQGQLGLFQRRTDRRAAIVHHVQLDLRPEQFLQHRQLRVDGVGGLDDVGAGLAGDDQQHRRQIVGKAGVAHVLHRVADLGHVAEAHRGAVVGVVVDHQRLVLAGLAQLVVGVHLPVLVVLLDGALGAVAVGRGDGRAHAVQGQPVLAHGIRVEVDPHRRQRAAADAHLPYPLHLRQLGRQHGRGEVVHLAATLGLRGQGEDHDRHVRGVGLAVAGIVRHTAGQQAHRAVDRRLHLAGGAVDVLLQVEHEHHGGRAQRTAGGHLADPGDPSQRALQRRGHRRGHGFRAGARQAGADHDGRKIDVGQRRHRQQAERQGAGQQQRQGQQRGGDRAADEGRGQTHRPASPSNPASVFRSSPRCLRQAAQRRARRSK

SEQ ID NO: 31531 - protein, 198 aa, Pseudomonas aeruginosa
ASAERNWSLASRVEARVGPSKLPLGPLRLLLVTVLRRSSRLSPAAASAVGLARTRTAGRWPPLMLTRPTPEICEIFCARRVSTRSWICGSGMPSDITARVRIGASAGFTLLNTGWFGRSLGSRLCAALIAAWTSCSATSRLLCRLNCRVITEAPPELLEDISLSPGICPSWFSSGAVIDEVMISGLAPGYRVTTWMVG

SEQ ID NO: 31532 - protein, 497 aa, Pseudomonas aeruginosa
SVSATPRRPAYSAMWTYSGETPDAPETAFRSPRRGPAPTPGRGRGLHPLVQRRGLRVHPLQPGAGAPGRSGAPGQRAAPADPRRTPGEPRPDALRRAGRRPPASGRRPSATAPEPGLDSRRSLSAARHHGLAAREPGPRRSARQRGAAGQPRTPGARPRPGRHLCRRTAVPWLRQLLGRLRLACRQQLQLRLEPVPRQRPGGEGRLRRPALGRRSLRPALRTGPGAARPPGQAAAPVAPRRLPRLPGAGGARRSHADALLGRFLRARPGYRRKPPATPAERRRPAQPAAEPRRAPCHLALPGIQRGRLAARRGRTGRQRPPERTPGEFAQRPRIWPGSQWRRRQRGAHGAGHGRRQPGAGAHPRGPGYRPVHRQPVVPELLGHARRTPDRNDPLRHLLGGERPDPGAGQHHALRRQPVQLPRRPPGRPQPRARTAPVQQYLRRTPDRLDAPAGRVDRALHPHALSPRGAPRRFAARERRVRNPKNDRRYSGAIITPP

SEQ ID NO: 31533 - protein, 142 aa, Pseudomonas aeruginosa
AREPSPGAARQAPPGSRKRPSWISTKAPTAPPPRPGPPCSGRPRSAAATTTTRRTPWSACSPSRTASPPNACMPTAARASRCNTPSRRSPARSADWSWPIPPTTPWSAPPRSRGRRSLPCRWTPRRPTTSSACSPPRNATPG

SEQ ID NO: 31534 - protein, 497 aa, Pseudomonas aeruginosa
SVRSRRPCGRRRKHSGPATMLARFTRAKTSGLSVAVPRGSTPGLGEILPGQAEHHRTQQQQGDQVGNRHQRVEGIRHQPGEVQLGHGAERNRQGPDDPERQDRPGARQVLPAALAVVAPAEDGGIGEHHQGQRQDVVADARHRRLERRRGQRRAAGAAGPDARGDDRQAGQAADDQGIDEGAEHTDQARTHRAMGRAGGLGDAGGAEAGLVGEDPACDTETDCRHHRCAGEAAGGGDRREGVGEDQLERAGNRLGMDHQDDHRGDDVADAHEGHQGFGDLADTADATKDHQPGDEHGGDPGDPVGHAEGNLQGIGHAVDLDHVADTEAGEPAEQREGRAEPGPALAQTVLDGIHRTADVFVALILLAVVHRQHHFGELGGHSHQRGAPHPEQRARAAEEDRRGHPGDVAGTDGGRQAGHQRLERADLAAALVILATPLPEQAKADSQAHQGHELQPQHQVQAGAENQHQHQRPPDHAVQVDHPLLQAFHQRSLFLFE

SEQ ID NO: 31535 - protein, 358 aa, Pseudomonas aeruginosa
NRNYGLYPDQCRAKNDDVFLPSREARHMKTRQLGHNGPSVSAIGLGCMGMTDFYTTGGDRQEAIATLHRAVELGLNFFDTADMYGPHSNEELLGEALRGKREQVFLASKFGIVRDPANPRARGVDGSPAYIRRAIEGSLKRLGTDRLDLYYQHRMDPQVPIEDSVGALADLVKAGKIRHIGLSEASAETLERAHRVHPISALQSEYSLWTRDPEDTGVLAACRRLGIAFVPYSPLGRGFLTGTLKRPEDFAADDYRRFSPRFQGENFAKNLKLVDKVGELAAAKGVKPSQLALAWVLAQGDDLIPIPGTKQRRYLEENVAATELRLSAAELAELDAIFPAEAVAGSRYSEEGMRLVNL

SEQ ID NO: 31536 - protein, 479 aa, Pseudomonas aeruginosa
HRHGRLDVRRAAAEQQPGGDQRGAARIAQGTGHQQRPLRQQFVDQHRGAPAVLDVRRDQVEQRQAAIGQPLRLAGKFGGSVEQCAEAAVGQFRGRRQAPQPEARQHLVRLRPATGPEPGVDPRGKQIWRQQPARGDAQAASAALLEAGGAEQQVVQRHQRQRQRRPAQPQRRTADGKGDGGAGQRAEAVASGQPPPLPVAAQTGAGERRGLRLRPQPDAQPTGQRAGGHVDEMVLPGGQHRQPDQREPAMQQPAPGAAGVARVADPEHYQQGDVQRRCLVVRFVEPHQHVEQPAEHAAQFRPFEGEAQGEQQEAGHRQHLGAEQAQAVGVQLALVPRQQQRQAVEQVDRPVRQDGPGPQRHPAFPVEDQAADVAALAGQPVGQAIAGEEERAEEQQPEHRPLQYPRLARRHQRATFCASDTLKMPHWSTRWVILRKPAAATSWSISAWVRRRITQAWPWRWLVSARAISSSCGCQGCPV

SEQ ID NO: 31537 - protein, 241 aa, Pseudomonas aeruginosa
SSAPSQFWPHGEVQAETAVVVERMGQVEAQRADRRDPAHAEADPGLDRREVQRVEGVALVDEGRQAPALGQRILILDAAGDHVAAADLVAIGILRRQRPVVVATHALVAASEEAQRGRDRLVVVGGDSAYLQAAEQAMAAGEAGQALGHGVDMEDVGVGQQAFLRPLDVELQAVAMAGVDLVVGLQQRVADPRHQEAAQPGVVAQLVLLAHPVQRNHPLPAIGLLAVPFAAKGQQLALGVD

SEQ ID NO: 31538 - protein, 279 aa, Pseudomonas aeruginosa
HSCFARTPTMKIVSFNINGLRARPHQLAALIERHQPDVIGLQETKVADDQFPQAEIEALGYHVHYHGQKGHYGVALLSRQAPLELHRGFPSDGEESQRRFIWGTFSDAQGNPITVMNGYFPQGENREHPTKFPAKQRFYADLQSLLENSFKPEQALVVMGDINISPEDCDIGIGEENRKRWLKTGKCSFLPEEREWLATLKNWGLVDSFRALNPEVNDRFSWFDYRSRGFEDNPKRGLRIDVILASRVLQSRFKDAGIDYDLRGMEKPSDHAPIWLELA

SEQ ID NO: 31539 - protein, 304 aa, Pseudomonas aeruginosa
IIPVDHLTALKVFRAVAANGGFAAAARQMNLSPAAVSKNVAELEAHLKVRLINRTTRSMSLTEAGEVYRQRLERILDDLEAADAALTSMQQGPSGLLRVSAPLTLALTCLTPAIPAFLQRYPDLRLELLLQDGRQDLIAEGIDLALRGSDRVADSGLVARPLLVLEHVLCAAPAYLSQHGQPLRPEALREHECIRFSLSGHADRWTFRKDRECIAVPIAGRYRVSSSLAVRDALLAGFGLSLIPRLYVQAELAEGRLVELLADWKADETAIHAVYPSRQLAGKTRVFLDFLTETMAQGHDSPTL

SEQ ID NO: 31540 - protein, 357 aa, Pseudomonas aeruginosa
PSDNSKRGGPMAALHAFLTEPFLGTATWFWLAFLAIVIVLLVLDLGVLQRDHHEIGVRESLLLSAGYFACGLAFGGWVWYAFGPTSAVEYYTGFLVEQSLSMDNVFVMAMIFSFFGIPRRYQHQVLFWGILGAIVLRAIMIGLGAALVKEFDWIMYVFGAFLLFSGVKMLFNKHEEEPDLEHNPVLRFLRKHMRVTKELHEHHFFVRLPDASGKLVRYATPLFFALVLIELADLVFAVDSVPAIFAITQDPFIVYTSNIFAILGLRALYFSLAAMIHRFVYLKYALALVLVFIGAKIMLHGVIGKIPAGLSLGVTFGLLAGGILLSLLKTRTPKATVEDKAEPNAEHALDRTSGHPR

SEQ ID NO: 31541 - protein, 332 aa, Pseudomonas aeruginosa
TFMIHMGVIQAPNNKKSRGASAMNLNKVDLNLFIVFDAIYTEANLTRAGQIVGITQPAVSNALSRLRETFNDPLFVRTAQGMVPTPMAQNIIGPVRNALQLLRVSVQESRSFDPQQANKTYRISMTDLTEAVILPPLFQRLRRLAPNVHIESFLAKRRETTKELAAGRLDFAVDAPLNTDPQVRHVKLMEDRYVCAMRRGHPLAGKPKLALDDYLGLTHIHISSRRSGLGYIDLALGKMGIQRKIALRSQHYLMASTVVQQTDMAMTVPERFARHHDLHYAVLPVSDVPKLETHLYWHESTDQDPANRWMREQIIELCQQVTARENKAAQPA

SEQ ID NO: 31542 - protein, 478 aa, Pseudomonas aeruginosa
ARCPVCAPPHSSGTSMPRKPRSAISRIASAGKRCSRSQSAANGFSRSWANCRAMSRIWISSSQGIIAGSSSSLPASAQALDGDRGRLAAADADRRHAAFQVVLLQGVEQGHDDPRAGRADRMAQRTGAAVDVEALVGQVEVAHCRHADHGEGFVDLEQVDLAQRPAGTLHQALHRTDRRGGEQVRRVGERSMPTNRRQRREPASLGLGKAHQDQRGGAVGNRTGVGRGHRAAFAERRLQGRDLVQPGLRRLLVAIHQALGLADGDRQRHDLGLEAPVAHGLLRAGQRGHGELVLCFAGEAVGLGTVLGEGAHQAALVVGVFEAVEEHVVEHLAVAHAVAATGALQQVGRVGHAFHAPGQRDPGAAGEQRVMGEHQRLHARAAHLVQRRARRAARQSGAKHRLARRRLALAGGEHAAEHGLVHFVGLQARPLHRGAHRRGTEGSGVDVLEVAEEAAHRGADGADDDDRIFAGHGIFLLY

SEQ ID NO: 31543 - protein, 448 aa, Pseudomonas aeruginosa
AAWPICPSNAATEAVLTITPRSPPSSGWPWDMASAARRSMLKLPTRLMSMTRRKLSRAWMPLRPRTFSAGATPAQLARPWRPPKASSAAATAWRPSASLAMSALTKRAWAPSSAALAAPASALMSASTTLPPCSTSIFAVAAPRPELPPVTRNTRFSIRTSFSPAESVRGGRPWGRLALPGDLLVAQEKALDLAAGSLRQFLEELDLPRVGVRRQALAHVSLQCVRQFRRRPVAGAEHDEGLDQFGALRVGLADHRRLHHCRVFDQRALHIERADPVARGGNDVVGAADEADAAVFVEFDGIAAQVVVADEGCGFQALVAGKPHQRRTPPVEGEDAWLAGRQFVEIVVQHYYPVPGTGESGGADPHRMRQGMVVAQHHAQLGLPVMIVDGGAEPVGEPADHLRGQRLAGAADRAHAPLQRSFRGRAGGHQQAIGGGRSGKVGDAVVHG

SEQ ID NO: 31544 - protein, 100 aa, Pseudomonas aeruginosa
IFAIGKSLFSAAFFQVPSGPQGEPMAEPQDKYTRRTGRTWADDQATYNRLREEADAARQKLRESGYSGAEYDQLRQAAFDLNRKANQYWEQMLSDLRQED

SEQ ID NO: 31545 - protein, 318 aa, Pseudomonas aeruginosa
TPVVIPCFFQCHPAARAVDRLHGPCLAPGYPDATDAETELVLQPPRRPARRPGRRPGADPRGHRLLHHRRGRPEDRPVRLLQHGGGDRLRRRPSGNDLRRDWRHGAADGQPGEGPRPAIPAGGDPALRRAADTRRLPAPGFADALRLALGGDRFRQCPGDPHLHGPATRTHRCRLAGLRDDRRGPGDRLRLPAPAPDRPAAALSAGMHPGPHRHIHLPGPGHPHRRRHGSVARQPAAVPLAGRAAEPRHPADRPALLRRPGGGRPSGVADDRHHRRRDDRHRQRQEPRMQGPGPGEHRHRPARRHGWLRDDRPVGDQC

SEQ ID NO: 31546 - protein, 600 aa, Pseudomonas aeruginosa
LPMPDIAVAQESSMATPPYPEDEHSRQAYVDQLGLLEEGADEVFEEILAAATSYFQTPIALISILDHQRQWFRASIGLDIRQTPRRDSFCAYAILGKGVFEVADATLDPRFRDNPYVQGEPRIRFYAGAPLATAEGLNLGSLCVIDREPRGPLAERDVAMLEHFARLVMARIHTLRSTNYIDEPTGLYNRLRLQEDVSLRLQRDGALTVIAADLLPLALLNTIIRTLGYPFSNDLMLEARDRIRAELPDFTLYKISPTRFGLLLPRQQQEETESVCLRLLRAFESPVVCRGIPIKANVGLGVLPLADDPLDGDQDWLRLVVSAADDARDRGVGWARYNPPLDQAQQRAFTLLTSLSQAIGTEEGFHLVYQPKIDLPTGRCTGVEALLRWRHPQLGFVSPAEFVPLAEKTALMRPLSDWVLRHAMAQLAQWNARNIPLRLAINVSASDMEDSSFLEEAVRLAKTYNIDLSALELEFTESVLIRDASAVGSVLLRARELGMGIAVDDFGTGYSNWTYLRDLPITAIKLDQSFTRDLAGSPKAQSVTQAVIGLASQLGYRVVAEGIETHDTFHLLQAWGCHEGQGYLIAQPMLPEQLEDWLRR

SEQ ID NO: 31547 - protein, 181 aa, Pseudomonas aeruginosa
ESDNPRPVPLPTGLVVKNGSKMRGRISGEIPCPESSTSIQACSTVCPVRITMRPRSGPIAWAAFITRFITTWLICDGRHFTSGRSPYSRTTSARYFSSLATILRVDSIPWCRSVHCQSSSASTREKFFRSWTILRTRPIPSLDSRSNTATSSLTKASSTRSPSCSRRLASASSRIAGRASS

SEQ ID NO: 31548 - protein, 287 aa, Pseudomonas aeruginosa
RVPSRISLIDTPAWRANDTPSLTRLTPASMLLIACPVLARMRSIIAVISWVDWVVRAASPRTSSATTAKPRPASPARAASMAAFNASRLVCSAIPLITWMIEWISSDDWPRAVMLVEDWLTTSAMRLIPSTTLRITCPPLLASSSDLAEITLALSAWSEICEILVIISSMLAAMLVALSACWLAPSTIDCEVWPMDWEVSWSSSLSWRMMVIICRRFSCISPKARCNCPASSSLSTPIGSCRLPWAITRAEATSLRRGLRTARSNWRQSCPRTRQATRMPPASIQAE

SEQ ID NO: 31549 - protein, 290 aa, Pseudomonas aeruginosa
RLAASPAFTLLDLNQRPSPRGFMPIDFLDIPFSSVLAVSRCRPRWTVDTRLSWGSRVSIASADRNHRLFPIDLIEAVANIESNFQTRSLTMSDAFLSSIKNRRTIYALDKQLPVSQEKIVELVKEAVSHSPSAFNSQSSRVVVLFGAEHEQFWNIAKDELKKIVPADAFAATETKLNSFAAGAGTVLFFEDQTVVRQLQEQFALYADNFPVWSEQASGMAQFAVWTALAEHKVGASLQHYNPLVDAQTHKTWNLPESWKLRAQMPFGAIAAPAGEKAFIAESERFKVFGN

SEQ ID NO: 31550 - protein, 409 aa, Pseudomonas aeruginosa
IGRQHFEAGIEALRRRHGRRNQCLPRIQSAFRLDEVACSSEGKLQATALADQVQIVTPDTTQPPLVIQLPERAKGMVDHHRHDRVRGEPTLLRRRQRHPGLVEAQAPPGAPAAQQFVAVAPANMRQGAIDEREQRFVTWPEQETETLAVDGCEVLDAQVQQVMGLDEVVRGNCVPQHAIDIPHAQRFQGKLRRVEPDDPAVRIGSFDTFGGKIALDRGQPGLRLRIERGTAGRHQYRPVGKIRSGCQQAVLSGLDLATDAKQVDLPLRQRVDCRLPRRKVPDAQRPLEHQGQVIGREALVGACVEDGQRRIVGGNHAYRQRLPCIQPLPGSFIEPGTHRCRRTPIRQDGFGFDGQRLQSDQQQAKDRGQQRPCQHVESTMAKFSGRTESSASATRSLRIHRQRCRHVSR

SEQ ID NO: 31551 - protein, 94 aa, Pseudomonas aeruginosa
IDEAACDDVRPGRGMPALESPVRAAHRRGQPGSVLEGWCDPFPGYYLHHPSQRQPSPTFSVVVEALRYRSAGLGTARSNVAAKATGARRRSKVQ

SEQ ID NO: 31552 - protein, 164 aa, Pseudomonas aeruginosa
SRPTCCCSARISAGSRCDVPVATPWMWISTCRTSRTGRSRPGCITPTSWRRPPTRCSATCCWASWNWSACASRKGTATCGHTRSISGCRCISPAQASPSPSPRNCSRPRSPLPTPPCSRPRWRSAARPSTPASPARWAATANASWHCWRCYRTATRASPGSPGS

SEQ ID NO: 31553 - protein, 208 aa, Pseudomonas aeruginosa
RYLSPRAGKPRACLMEKTMLIHFCPRLLTPAGFDLPCELIDIRIKEFDLHLLGGRDVVARHPLPDKRYHVACRKSGCKAVNGLLVDVEKHVPLFTVDTRWSIDAEVVLRHRVEYVVLDAEHDAVSDYMLLWCDEVPNYFLGQSTPAMQVPLMELMRGNALQTERQDVFRLPTLRSERLRQGNADANQHLPSREQAFHVKAEQISYGLA

SEQ ID NO: 31554 - protein, 325 aa, Pseudomonas aeruginosa
QSLGVEGVGDALLLVETICAHRLYVVAAPRIRLLDGSGIEIAPQRPQHLGRVGRVALEPAPGALQFGEDLLEHFRMFPGVVAGGEVVALVAGQALAVGQYPRALLALGACHVGVPGHPGVDLAVLEGGAAVGWRQVGWLDVGELKPGAGQRGDQQVVAAGGLGHGDALALQLGQGLQRRMFADQYRLRRGRRCFAGEVGQASTRRLGEHRHGVGDVGGEIDVADIERFEQRQAAGELMPGHPDALPGQLALEGALAADQGQQSRGFLEADAQDLLGLCATNARQDDGSGKHDGQATQERTRHAMTPRIGASARRDGSSSCRRRNG

SEQ ID NO: 31555 - protein, 456 aa, Pseudomonas aeruginosa
ITYSYQLMPGQRLPDIRIRRLPDRKAAGEGRPHIEALRNQSMGLVEIGGLLLLAERSLIQRLPTQAPAFELQARGVLGEADDLRQASRILVQVQVRPALGAGQALQVVLQHGAFRRVGQCAIGSSEEAVASPQAATVDQYPSLVGGLRERGVGLPGRPGIHGTIGEGHFRVHRAEEAEFDVLLAQPDRGQGLERDEVADGTAPGGNALTFQVVGRAQRRIPSHQHGGTVGIGFVDGDGLQPGTGGQGEEQWRVADDAGIHRTGIECFGEGGGGGEFEPADVVGQVVQRAGSLQLGAHVALLVGQAQGHALVGTGLADEQAEKQEQAQGLTHSVTPQRWPTRRSAGNWRATSAAPADRLKSNAGATSSDFGSTPSAWKKSAAVCRVAATSGPKTTGLMRASPTQRRVTSRGMFRSLARASANASGCLRAQAWARARRVSRSLIAAFLRAIAASLARA

SEQ ID NO: 31556 - protein, 828 aa, Pseudomonas aeruginosa
SLCPDSCQPSPTRRASVPGRPPRDGEPSSGSTRRLLINAPCSSTSRATRRLSAPGQSGLSARRRKCRYCMHSTRAVEGSPRATAPITRRSSPRLAPGPPSAGGKARASSPWCRSRARLAWGKSPLRSWASALSASCRVSSGSHSSNAAEGVCRTAMGSGRGAPALALGDFGAGQRDQLAAIFHGIGEGIETANEDIAHAQVVVGEQGVGHLFRGTDQGGGVVPATDQPGDSGPKALVEALALLHRLEQTLGADALRLALGEAGLAQARAGACAYRLGLGPGLVLRAPEDGPERQAELHFATIRARLFAHSGDGFGGLCQGFAPEHEHIGLLAGDLQRGFRGAAEIHRNVRFLLRTDGREGVLHAVVRAVEIEGFGAGPGALEQFDEFVAAGIALVVVEIIAVLALVGVAAAADDMHRQAPVEEVFEGRQLARGQGRGDETGAVRQQQTDPGSGQASGGGHQESIRLVRPVADQDSIEAGLFVGACESGDVRLVEDRSDRREGLRGQAMADHAEKLDAHGPYSVEGFVERRVDPRGSVERLGQGTGLQQEIRGLLVVGGGLGVYRADAHAGLADPMAGDCPVEIGLLRPEVGVLLLVCLDPGPCLAQAAEEVGDLRAPGLDGSSVGGDAGQPRHQVAGGENRPCAGNHDLLRDIRLPHRKGIDAAARQGGGGVDRHQLDELHVVLRQAGFLQRAQGQLLAPGTGPVGDFPALEIGNAAHRRILRHQQGYGIGVLPRDADQLHRRTLGGEEDEARVAEETQVQRSGLQPFGHRRGGLEMLPFDLVRRAFENSRGLHGSPHVVVVLVAHTQRRQLCGLGQGGTEQKRGEAG

SEQ ID NO: 31557 - protein, 147 aa, Pseudomonas aeruginosa
QVLLEFHRSSSTGVPQQRQAGDMVMYGGNQALAVAHGVAERLEASNQEGRDAQPVVLAKRSGNLLGGAYQGGGVPARPGQPGHAGPQTAVEHLALLGGGQQALRTDVLRLVVAQRQTEARTVLADLFEHLGGTLPGGLLGIRDDRPE

SEQ ID NO: 31558 - protein, 552 aa, Pseudomonas aeruginosa
GKTLHFRLFQQPLAQYLGPVEREPRMSQIAVRTFHDIRAALLARRELALLDVREEDPFAQAHPLFAANLPLSRLELEIHARVPRRDTPITVYDDGEGLAPVAAQRLLDLGYSDVALLDGGLSGWRNAGGELFSDVNVPSKAFGELVEAERHTPSLAAEEVQALLDARADAVILDARRFDEYQTMSIPGGISVPGAELVLRVAELAPDPRTRVIVNCAGRTRSIIGTQSLLNAGIPNPVAALRNGTIGWTLAGQQLEHGQTRRFGAISQDTRKAAAQRARAVADRAGVERLDLAGLAQWQDEHDRTTYLLDVRTPEEYEAGHLPGSRSTPGGQLVQETDHVASVRGARLVLVDDDGVRANMSASWLAQMGWQVAVLDGLSDADFSERGAWSAPLPRQPRADTIDPTTLADWLGEPGTRVLDFTASANYAKRHIPGAAWVLRSQLKQALERLGTAERYVLTCGSSLLARFAVAEVQALSGKPVFLLDGGTSAWVAAGLPTEDGESLLASPRIDRYRRPYEGTDNPREAMQGYLDWEFGLVEQLGRDGTHGFFVI

SEQ ID NO: 31559 - protein, 215 aa, Pseudomonas aeruginosa
SSTRPARSSTAANATTSWPPSACTCRSTTCSSACCRSSASPAATTDRKRLRKSPSPRRAFSFADRQNTGIGLSFEEILRVSQHEIRHRPIRPSPLPRRPPRAALQRSRAGRRARNRPPVLLPGRRAQRLGQRPGAGQNNFNLARPPGREFVERNGLDAVVCIAAALRRGVLNAEEAERYGRPGANLGAPWELSGLGQLHEAAQSADRLVCFGGDR

SEQ ID NO: 31560 - protein, 197 aa, Pseudomonas aeruginosa
RPPGQLPVPAQPRRRPAALRRRRARPAGRQPRLPGPGTDAGGNRTVRPAGRPPGARYRGRPRSPGGGGLPRLRRTRHPLRQGQQLAMTLLMLEGREIRLDKDGYLAALDDWSEPVAEALAAREELALTAEHWEILQLLREFYAEFQLSPANRPLIKYVAQRLGPDKGNSLHLNHLFKGAPAKLGAKLAGLPKPSNCL

SEQ ID NO: 31561 - protein, 143 aa, Pseudomonas aeruginosa
CARTAGPSTPPTAPPAIASTAWPFCTSETPATTRTTAAGSRCRCCGTSRRRRSSTTNQPISSASSTAPSTPSAPTRWTSTRSRCARRSNASTDASIRRSTTACTVLASPLARTPTRRPSSSCSRSWTTWKACSANAATWPANT

SEQ ID NO: 31562 - protein, 236 aa, Pseudomonas aeruginosa
YRWARVSTWRAHQAGNDFPARASGEKAEGSGVLAGAFEPGQLVAQLHDFADDHQGRRMHFVLSHQLRQVFQGSGEYPLLGGGPLLDQRRRGLCGATVGDQLLADHRQSHQAHVEHQGLARRYQVLPRQVGGAVLQMTGDETNRLRMVAMSQRNPGVGRAAAGRSDSRHDLERYAVGSQFVDFLTAAAEDERVAALQAQHALALAGQLHQQAVDPILRHRMFGAALADVQAFGIAAA

SEQ ID NO: 31563 - protein, 180 aa, Pseudomonas aeruginosa
QFLDPVAEAAGESGQLPVGRGNPGFQLGPDQPRQHGRIAAAGDRHHQRRTVDDGREDHAAQGRRVHHVDRYPARIGRSRHLGVQRFVVGGGDDQGAAGLVAVLVVAFEQLAAALLHQMPQFDVDLRRDHAQARAGVGQQARLAQGDFAATDHQREAPLQGVEQRQEIHVSRSPRCQPCRA

SEQ ID NO: 31564 - protein, 165 aa, Pseudomonas aeruginosa
GCAPARACRFPDCGSGPACAGPGSRRSWSRRKSRGTCPGWEPRLPGRRSWSNRSPCRRCTAPAPDTATRAVAGRARRWRSGLPAPRRKWPDRRSAPSPPCRTDAGGSCRGYRARRHRPRCGSTGYGRRTSAAIAWRRGSARRRCWSAKPRRSGSGRGQLRRRGRS

SEQ ID NO: 31565 - protein, 833 aa, Pseudomonas aeruginosa
NLSGSITNRRRRDDFAGAVGIHRGDHAGHLHRLDHPRGAVVADLQLALHGGDRCPATLGDETYRLVVERVVLAAFAGAVAAIEGTATAAAFVDASEDVLDVVGRAAQLPGLDHPVHLVVGNEGAVHANRQACARRQVEHVAVAEKLFGATLVEDGARVDLAGDLEGDPGRDVGLDQAGDHVHRRPLGRQDQVDTGRPRLLRDTGDKLLDLLADDHHHVGEFVDHHHDGRQGAQLRRLVVRAFATEQRVGQRRASLLGVLHLAVEASQVAHTHGRHQAVAPLHLRHAPAQGVGGFLHVGDHRAEQVRDPFVDRQFEHLRVDHDQSRLARRGLEQDRQEHGVDPHRLTGAGGTGHQQVRHLRQVGDDRPTADVVAQGQRHGGLVLVVLRRRQHFGEAHHLPVFVGNLDADSGLAGNHFHHPHADHRQRARQVLGQVGNAADLDPRRGLDLETGDHGARMHRIHADLDAELLQLDLQQARHRLQRLGRVALLLHFRRVEQRQRRQGALHRRIDEQRRLLLFQHALARLRGLRRRWRIDLRRRALLPLAHVLGQGLFAFQQALLGLGLFAAVRHARRHHLGDALVDLAQLRDQLLALGARAHPAIEGVLDQFEEVQGDLAGDIHHLEPGEVGEHRQAEEEQGEEHQRAALHVQRIHRDAAQALADGAAGRGAGRHVAAGVEMDVGQCRAGQDQEDQPDQAPGKQPGVPFPRQVAAAEYLPGLDAQQQRKEVGEVAERHEQDIGGYRTEPTGGILHLVNLARVTPARIGRVIGEQSHPQVEAERAQRDQDPFLQAGMQLLTPCGGMARGGRILQIAIFPAHGWCFRSCLGQNAPIVRL

SEQ ID NO: 31566 - protein, 221 aa, Pseudomonas aeruginosa
SLPPVPPRNTWACRRKKPSWARAFPPAPPATVFLPQPGGLRGRRRQYRRRGSAVPGQHRQGSPPDPPSRQAALGEDPPGQAVRQGRERQRAPALEHHPGRGAGRRQRRHRRTPEEHHRRQHQRAIAGRRVHRHRPQAEHRPVPGPTGNARRLPADPRRQRRQCHPDQHRRRVRRRRRGRPRLPPGHHFRRRRLHGRAGCRKIPRRPLIGPGGGPPSPTPPC

SEQ ID NO: 31567 - protein, 148 aa, Pseudomonas aeruginosa
SRLVPRRVTTPTAPGSPRRCNWPTRSCTCAASPTPWKSGRSDNWSAASTAWPWAGCSSANRCSAAPTTLPRSASSRWSAICATPASSSSTARCRPATCTAWAPAPSAGGNSPTTCNAIATSLLPATWIFRRVSVPGINLLMGPCWSSP

SEQ ID NO: 31568 - protein, 65 aa, Pseudomonas aeruginosa
TGERISPARGWYTARHDFAVIEVRAVWDQTLSPRSVGFATMNPPYNALLAPLYPAAYLDFDSTRC

SEQ ID NO: 31569 - protein, 65 aa, Pseudomonas aeruginosa
CSTTWRPATSGAPARPRTHRSATGSSWPSPAHASPIPRRSSGWTRSAPTTANCARRSSCTSRTTT

SEQ ID NO: 31570 - protein, 379 aa, Pseudomonas aeruginosa
RLIAMSESAPTPRRERVIVGMSGGVDSSVSALLLLQQGYQVEGLFMKNWDEDDGTEYCTAREDLADAQAVCDRIGIKLHTANFAAEYWDNVFEHFLAEYKAGRTPNPDILCNREIKFKAFLDYALMLGADLIATGHYVRRRDRDGRTELLKGLDPNKDQSYFLHAVGGEQIARSLFPVGELEKPEVRAIAEKHGLATAKKKDSTGICFIGERRFTDFLKQYLPAQPGDIETIEGKVIGRHSGLMYHTIGQRQGLGIGGLKEAGDDPWYVLGKDLQRNVLLVGQGNDHPLLFSRALLASRIYWVNPVELERPRRLRAKVRYRQSDQDCVLEKTAEGYRAVFDEPQRAVTPGQSVVFYDGDVCLGGGVIETAEAWDFGGRP

SEQ ID NO: 31571 - protein, 408 aa, Pseudomonas aeruginosa
SASASTRSNSRSSTSAWSTRTSSPRSPASTRTPSAPSASASRYTATCATCRSAATPRGSAPCCSPASARRGSGGNWAAAAGRWYSAGAGCSTNSIPCCAASHGHGREPAATAQQPDPGRRHAGSFGAVLRPDGRPDPRGLQHRQQRNRGVLPQPRRRAVLPAPGADSRHRPAAHPPPAIAPAAHHLRPGRHVLLLLRPRPPAADRRHAVQLCRAGVHAADRTPVDQGAADPPHDGRHPGRLPRRAAGGQAQRRGSGADRPGRHRLQPDGCLRLRLDPRNERQRASLSHRVLLRPVRHPVLRRAAGLGLAAAERPGTAPAARRRTVRQPRPTDHVAGLCPGLPGSDRTDRLHGHRFRRGDRLAALGRTAQPHVAARRRPDFRRQPDPPAGQPPRRKAPLNAPPGRTFHV

SEQ ID NO: 31572 - protein, 873 aa, Pseudomonas aeruginosa
LPATRTSHAAFLAHRGIPRRWPLCRQNQQPASDLQRIRPDPFPRHGGSPLAAAPRRPRRDSRGRAVLRRSQRPARQPGQRLPAGTRRTHQGNRAHHQPRRESRGVPAQGTGRQAPGAGRGQRVHPLRLHLRGHQQPVPRPDAPRGSRQRAAAADAPDRRGHPRTGGEIRRRADALPHPRPARLADHPGQGTGQRRLPPGAADQAGRRHRVAGQDQRRRGQLQRPPVRLSRSRLGSQRPPVHRRRPRPDLQPLHHPDRAARLHRRAVRCDRPLQHHPHRLRPRRLGLHLPRLFQAEDRGRRDRLLDHAAQGQPDRLRELRGQPRHRQRAVPAPGQQAADLALAARPDRLHRAAQPRRRHRPQRHRLRGQPEGHRQAGAERPAHRRGPGRLLGSPCRAGADRDASLWRGKPLREAEGTDPRQRHQRRSLADFHRRAGDSRRGQGRAEEADPGRLRRQCRRPGQAHLSTQPFCTPGCAGRFCFKDLTMNADTPLQLLGGLTAAEFLRDYWQRKPLLVRQAIPDFESPLSADELAGLSLEESMESRIVLEHGKTPWEMRRGPFQEEDYQHLPEQDWTLLVQAVDQFVPEVAQLLEQFRFLPSWRIDDVMISYAAPGGGVGPHFDNYDVFLLQGHGRRRWKVGQMCSSDSPLREHADLRILADFEQSDEWVLEPGDMLYLPPRLAHYGIAEDECMTYSIGFRAPSAAEVLTHFTDFLGQFLSDEERYTDAGLQPVGDDPHQIQRDALERLQGLIQEHMSDERLLLTWFGQFMTEPRYPELVAGEEIPEEELFGALEDGALLVRNPSARLAWSEIDIGLVLFASGQSVLLPGQLKELLKLVCSADALHLENLGQWLADDDARKLLAELVKQGSLEFADE

SEQ ID NO: 31573 - protein, 97 aa, Pseudomonas aeruginosa
AAGALRASAGSPRPCPGPPAAGPPLALPAQSRPGKLALSPQQHPGSLHPFPPGQSTQSPAYPRWRQRPGRAQRPPPDQPFAPPVEQLPDPPAQPGLP

SEQ ID NO: 31574 - protein, 332 aa, Pseudomonas aeruginosa
RGRRLPPGRRPGPATAPETGATGGLRLLPCRRAGASTPGPLRAGLGHQPFRPGPAELPPVTLLRTTLLSSLLATVVLGASAAPRTEVIPLNYRTADDVMAVAQSVIGIEGKVTAYGNQLIVNAEPAKIRELQSVLQQIDSRPHRLLITVDTSENLQQDSRGYSVDGSASAGNIEIQSGRGEVNGKDRVRIIRRSTDSRSGGSQQVQATEGYPALIQVGQSVPITSTATGPYGQIYSQTEYRNVNRGFYVTATLTGNLVHVTISSSNDRLSQSHPGVIDTQSTDTRVSGKLGEWITLGGVSEQNQADQHGFVRRYSTQGRDDTSLRLKVETLD

SEQ ID NO: 31575 - protein, 629 aa, Pseudomonas aeruginosa
RDCDWNEVVLRDGEAFTYQPDRKTRQRVAHRQPRAERHLIQSRSTVRELFVSTPSSASFFATVILSPCSGEPPARQPSPAGFEWVSRCSTNTFLEGLTMSAYQNEIKAVAALKEKNGSSWSAINPEYAARMRIQNRFKTGLDIAKYTAAIMRKDMAEYDADSSVYTQSLGCWHGFIGQQKLISIKKHLKTTNKRYLYLSGWMVAALRSDFGPLPDQSMHEKTAVSGLIEELYTFLRQADARELDLLFTGLDAARAAGDKAKEAELLAQIDNFETHVVPIIADIDAGFGNAEATYLLAKKMIEAGACCIQIENQVSDEKQCGHQDGKVTVPHIDFLAKINAVRYAFLELGVDDGVIVARTDSLGAGLTKQIAVTNEPGDLGDLYNSFLDCEEISEAELGNGDVVIKREGKLLRPKRLASNLFQFRKGTGEDRCVLDCITSLQNGADLLWIETEKPHVGQIKAMVDRIREVIPNAKLVYNNSPSFNWTLNFRQQVFDAFVAEGKDVSAYDRNKLMSVEYDDTELAKVADEKIRTFQRDGSAHAGIFHHLITLPTYHTAALSTDNLAKGYFADEGMLAYVKGVQRQELRQGIACVKHQNMAGSDIGDNHKEYFAGEAALKASGKDNTMNQFH

SEQ ID NO: 31576 - protein, 157 aa, Pseudomonas aeruginosa
WRRVAQQPFEQPAHERPDRRPRPPPGPGRRRGARRPRLPRRRAPRQRRSRRSAGARRGRPARLAFQTPQPLALRSHRQRPRRYHPGARRLQGDALHTLGHPDQRQLSGIPRRRQQQRPGPGRTDRHAPRRHALLPDRRAVRLRRRTHQQPWPAGAQP

SEQ ID NO: 31577 - protein, 447 aa, Pseudomonas aeruginosa
SAQGNQRPWRFRRGDPSQRAWRVECRTVATQSADHRRHADAYRRPGARPRTAAHPPQSGRHPHPRHPQQLFQRFHPLGHLPHLRGELGRLFLHPGQRTAARTDPLRHSQHQPFRLGDPGGRRVRALRRHPQGQTGSGRLPQRTEQLRLDRRDRPVRPAIGTGQAHRSRPLRPRRPGLRPGQAGPPGSLLLRRRLAERVHLQVRQPRQVPSGSQQRSPARRRYPLRRPLQRRWQRPVAAAGHRRRQLPRGLSQGRGELRRPGRSADQHPPGRRCPRRDQDGSPGVGRGQPGQRRRLLHPHQQHVAHRRRRRQPTGEERLRPYHPLARTQPRLCRATLHLGPVHARRSRRRQPRPGRQAAEPGQYPGQPRRPLVRPGRPPVDPDRHERQPVEQRPVRQQPDAGGRPAHRRTEALPHRSAGLRGDRHCRDAGLPYAVHQHPAPGGRLDRR

SEQ ID NO: 31578 - protein, 235 aa, Pseudomonas aeruginosa
GLAKSPPPRFAAIRPKASQAAPFLAETAFTRLSGINQSAGKSREASVCVRKIYLSGALGIKSERYIQPLAHYAAGCTRSRALRPEPTILYIRYRRSISMPNPAELAAHHWGFAAFLLRVVGLLAFMLGVSSLLGSKAFGRSKNEPFESGIVPTGGARLRLSAKFYLVAMLFVIFDVEALFLFAWSVSVRESGWAGLIEATIFIAILLAGLVYLWRIGALDWAPESRRKRQAKLKQ

SEQ ID NO: 31579 - protein, 205 aa, Pseudomonas aeruginosa
PKATETMTADSALYIPPYKADDQDIVVELNSRFGAETFTVQPTRTGMPVLWVPRERLIEVLTFLRQVPKPYVMLYDLHGVDERLRTHRRGLPSADFSVFYHLMSLERNSDVMIKVALSERDLNLPTATRIWPNANWYEREVWDMYGITFTGHPHLTRMLMPPTWQGHPLRKDYPARATEFDPYSLSAAKQDLDRGPCASSRKTGA

SEQ ID NO: 31580 - protein, 393 aa, Pseudomonas aeruginosa
SATGENEDYMFLNLGPNHPSAHGAFRIILQLDGEEIIDCVPEIGYHHRGAEKMAERQSWHSFIPYTDRIDYLGGVMNNLPYVLSVEKLAGIKVPQRVDVIRIMMAEFFRILNHLLYLGTYIQDVGAMTPVFFTFTDRQRAYKVVEAITGFRLHPAWYRIGGVAHDLPRGWDKLVREFLDWMPKRLDEYETAALKNSILRGRTIGVAQYNTKEALEWGTTGAGLRATGCDFDLRKARPYSGYENFEFEVPLAHNGDAYDRCMVKMGEMRQSLRIIEQCLKNMPEGPYKADHPLTTPPPKERTLQHIETLITHFLQVSWGPVMPANEAFQMIEATKGINSYYLTSDGSTMSYRTRIRTPSFAHLQQIPSVINGSMIADLIAYLGSIDFVMADVDR

SEQ ID NO: 31581 - protein, 537 aa, Pseudomonas aeruginosa
SDIPPAGGPPHHPRLRQHGLLHRRPRVGGRRDPEATRHRSRPDYRRRTLHPAPGLLPGQLRQGPGADDRRRHSWRRASRRCRQTAGGLRMTLTSIGPANRMARSAETHPLTWRLREDAQPVWLEEYQSKDGYAAARKALTQMAQDDIVQTVKDSGLKGRGGAGFPTGVKWGLMPKDESLNIRYLLCNADEMEPNTWKDRMLMEQLPHLLVEGMLISARALKAYRGYIFLRGEYVDAARNLNRAIDEAKAAGLLGKNILGSGFDFELFVHTGAGRYICGEETALINSLEGRRANPRSKPPFPAAVGVWGKPTCVNNVETLCNVPAIVGNGVDWYKTLARPGSEDMGTKLMGFSGKVKNPGLWELPFGVSARELFEDYAGGMRDGFQLKAWQPGGAGTGFLLPEHLDAQMFAGGIAKVGTRMGTGLAMAVDDSINMVSLLRNMEEFFARESCGWCTPCRDGLPWSVKLLRALERGEGQPGDLETLEQLVNFLGPGKTFCAHAPGAVEPLGSALKYFRAEFEAGISRQPSAAPRPATVGA

SEQ ID NO: 31582 - protein, 137 aa, Pseudomonas aeruginosa
TAASPATAACATTRTTPAAPTSASTAPTTTSTSDGSRTACWKASSPATSPRSAPPACSPTRPTPSATTASGTCSSPRASATAAPAAATSAPASATARSAASRTATTARSTTTSSATAVASATATSTAKTVRASRCWC

SEQ ID NO: 31583 - protein, 194 aa, Pseudomonas aeruginosa
SSPITSRPPPPPRRTWCCRRPASPKATAPWSARKAAPSASSRCSTRPTTTPGTWSARAGAGCMRSTAPCKASASTGPSWTTSPKPWPRQSRSWPASATPHRPPRSASRASSWPANRTGTAGAPPCAPISACTSRAPRRTSTRRSPSPWKATPAARKTVSRSRSPGRRAGTRRRPGTSSRTRSAATCAPATPACA

SEQ ID NO: 31584 - protein, 217 aa, Pseudomonas aeruginosa
PGDGVQLEGVPAADPDQPAGDRRARAGRGPVRRTTVIKEIINVVHGTFTQLRSLVMIFGHAFRKRDTLQYPEEPVYLPPRYRGRIVLTRDPDGEERCVACNLCAVACPVGCISLQKAETEDGRWYPEFFRINFSRCIFCGLCEEACPTTAIQLTPDFEMGEFKRQDLVYEKHDLLISGPGKNPDYNYYRVAGMAIAGKPKGAAQNEAEPINVKSLLP

SEQ ID NO: 31585 - protein, 449 aa, Pseudomonas aeruginosa
RGAQGIHRHPRRRRVHGFRPVHPVPAVRHPEHPGAAGAGAAEVPGRQPLADPGDPGPGSAARSASPPSCRCRPGWPTPWPARPRFSALIHAATMVTAGVYLIARCHGLFTLAPDILELVGIVGAVTLVLAGFAALVQTDIKRILAYSTMSQIGYMFLALGVGAWDAAIFHLMTHAFFKALLFLASGAVIVACHHEQNIFKMGGLWKKLPLAYASFVVGGAALAALPFLTAGFYSKDEILWEAFASGHRELLIAGLVGAFLTSIYTFRLIFVAFHGEPKTEAHAGHGISHWLPLSVLIVLSTFVGALITPPLAGVLPESVGHAGGEAKHSLELASGAIAIAGILLAALLFLGQRRFVSALAKSAPGRFFGTWWYHAWGFDWLYDKLFVKPYLLLCQLLGRDPIDRTLGVVPFSVRGGHNLLSLTENGRLRWYAASLVGGAAILLGALLLA

SEQ ID NO: 31586 - protein, 518 aa, Pseudomonas aeruginosa
RIHGETEPVMILPWLILIPFIGGFLCWIAEHSSKTLPRWIALLSMTLVLILSLWIWATGDFQLAPAPGGEPEWTLQFKVLWIERLGISIHLAMDGLSLLMVALTGLLGVLSVLCSWNEIQRRIGFFHLNLLWILGGVIGVFLAIDLFLFFFFWEMMLVPMYFLIALWGHSSDDGKKTRIYAATKFFIFTQASGLVMLVAILGLVFVNFNATGVITFDYATLLKTQLSPHVEWLLMLGFFVAFAVKMPVVPVHSWLPDAHAQAPTAGSVDLAGILLKTAAYGLIRFALPLFPNASAEFAPIAMWLGIIGIFYGALLSFAQTDIKRLVAYSSVSHMGFVMIGIYSGSQVALQGVVVQMIAHGLSAAALFILCGQLYERLHTRDMRKMGGLWSRMPYLPAISLFFASASLGLPGTGNFVGEFLILIGAFKVVPVIIVIATFGLVFASVYSLIMIHRAYFGPSQSDEPILGLDARELSMVLGLAVLLVLLGVYPQPVLDISAASMHGVQQWLGAALSTLAGR

SEQ ID NO: 31587 - protein, 419 aa, Pseudomonas aeruginosa
PRRAVPAPAAGHRRRPGAGQRAAPGQPVHRPGAALGPGLRDGRLRLLQQALAGSRHQVHRALGRRVRLPAVRHGPALRRVRYPGLRRPWRQGCRARAERSAGQRWRRHDAGRPGLQAVAGALPPVDPGCLRRRPGAGLGVPRHRQQGRGVRRAAAAVPDRPGGPGQPTAEHLPERHRGRLDPLRQPAGTDPEQHQAPARLLVHRPPGLPAGRPDRQQGHGRGSGRRLPGHLRTDLPRRVRRDHPDVHPVQRPRRRCAVRVPRPVLAPAGTDRGDDRDDAVAGRHPADRRLHRQVLRDRGRRRVAPVVADRRPGAGQRHRPVLLPAGHGHPVPGRARHPPARRTVQLGPARRRHHAGGHRPAGVLPRRLPAAAAGNPPAFRPGPRRLSRPLHENPASAGFFFGPPHAPCPAAVACSALHG

SEQ ID NO: 31588 - protein, 429 aa, Pseudomonas aeruginosa
SGTVMSKHSRLEKAFLRSGILVDRQQDIVTLTRRHDGTSAQILLPASFALEEKAVRQLLDFASVQAPGDTGHVCKACATPDFHPGSIAPVGSIVASTADFVIPAAIGTDINCGMRLLRTGLTLSSAEEHRQALVAGLTHVLLRNGRDVPLRVQAFEALFAESPGHCLERLSEDGLWAEVDQARLFRELQGCIGLDEFGGRLEYAPEALRDRRRSLIRDPGLGTTGSGNHFVELQVVDRLLDRHQAFALGLRADELVVMIHSGSRDVGFHVGQRWMDRARTAWPRGRRHPASGLYALGGELAGEYLQAMGGPCALCLAEPGGAGGAGAQGLARDLPARRQRPAGGRPAQRGAPGTGPESPPQGRHAGPPGRSAADSRLDGRLLVHRQRPGTPGLAMVLQPWGRPQHPPAGATSAERPGRQRAALALRDPP

SEQ ID NO: 31589 - protein, 307 aa, Pseudomonas aeruginosa
GAPHRRGPGRLQAGGAGDRCPGACRADPAAGTLASVADLQGLKRTSPAFAGLVCHGRDSGLRFFLAASEQVPAGHEQRSDQRADDEAVETEQGHAAEGGDQHHVVRHLGVLADQDRAQDVVHQADHHHAEQDQHYALPDRPGEQEIGRHRRPDQRRADGRQQRQEGHQGAPEQGALDAQQPEDQAAESALGGSHGDVALHRGADHRGELGEQVVLVFLAQRHRLLDPPAEHATVAEEEEQQVEHDAEADDEVEGVLADAERLGRHHLAGLHRHRGELLLQAREIGPGRSAPTHWCTDGGKAATACCR

SEQ ID NO: 31590 - protein, 389 aa, Pseudomonas aeruginosa
PTSRPRPWPSCARLRAVCAPCWASSATLSTAPAIWCTLRLISSATAVCSSAALAICAFIALMVAISWAMASSESPAWLAWLLVPSPASPERRMASTAALVPCCRRSIMPWISWVLCWVRLASARTSSATTAKPRPASPARAASMAALSASRLVCSAMERITPSTLTMDCTSCCRLSREVPLSRISSTSAWMRSMLPSTTRLAAWPSWSVCCAASAARWALCATSWAAADISLIAVATWSVSWRWRSMACSERSAWADICSTSCLRSPVIPAICRTRPWIFSTKRLKEPASSPSSSWLVTGRRRVRSPSPAAMSSRFWRIWCNGRSIALATARPITSRTTRRTPAIPTILAIRVPIRSSMSCLISTNWASTPSRLIAEPITMSHFGRYRV

SEQ ID NO: 31591 - protein, 206 aa, Pseudomonas aeruginosa
ALAARPLFCNGNSTLTRRPPSGLSSRLRRPPQASAMSRAMPRPRPWPLTCSSSRVPRSSTAWRWSGRIPGPSSSTFRRTMPSPCATVRRTSLSAHLQALSSRLPSISSRSSRSHGRRSPGGALQLTCRCGPWIRRRVSHSDGNSSAQSKCAPGSASPTRRALPNSRPRRCWICSSCSRRTCCNSGWRAISSRSARLTSTASGVFRA

SEQ ID NO: 31592 - protein, 394 aa, Pseudomonas aeruginosa
GNGKPLRWGSPAFESAWSCDNSSYNRRSAREKTSMPAIQIKSPALTLKAGRRALARIRERGLQPADVGIVPGAAGGPKALGIQGLDLAIFGEWLPRAPRERSLIGASIGSWRFASACLPDAVAGLTRLGELYTRQRFPKGVSIAEVSRKCAAMLDDLLAGQDARILDNPLYRLNVVVVKSHGRLAHDHKASLGLGLSSVIRDNLIGRRHLHRHFERVILHDARQAPPLAALTDFPSRYLHLDGGNLRQALLASGSIPMVMEGVRDLPGAGPGTYRDGGLLDYHLDLPYEDRGVVLYPHFTDKVIPGWFDKGLPWRRGDAGRLQDVLLLAPSREYLARLPHAKLPDRKDFTRYLGDDDGRERYWRQAMAESRRLGDEFLELVDGGRLGERLQALD

SEQ ID NO: 31593 - protein, 133 aa, Pseudomonas aeruginosa
ATWSTGTMRVFTITWRTTCAACWLLASSLPALAAPSPQASQEIGRLLSFVEDSGCTFIRNGSEYPAAEARAHLQKKLDYLERKDLVASSEDFIERAATQSSLSGKPYQVRCATQTRNSADWLNQELRRLRQAP

SEQ ID NO: 31594 - protein, 217 aa, Pseudomonas aeruginosa
STGMAVDPRTTQHRRIEPGEQQERQSPQSACQGQRPVRRQQAGQEHPRRAAEIEQSESPGHRCRRLQRATGMAESDPCQHRQDQPAHAAHRQRVQRLARRQRQAQAPERHAKRRHGDPEICQVQRPEQRHLPDAAIAPTPQAPQLRTTEGGEQSCKPGRRLRRDARGGEQRHQHAAQQDAIVQPGDRRHLLLTAETAVGEERDHPPADQVHHPGDQP

SEQ ID NO: 31595 - protein, 165 aa, Pseudomonas aeruginosa
PERDGEDREQRAAEEERAEAQAPDRRYGHQPGTIKHLHSRPPNRVDACGTARSGASRSRSSTGSGRGSPAHGKTPAPACSGSGRGNRRRSRRRRAAPGRPPAARDRSAAPAVDNRTERSSRSPFSEKGPTHLAPARRFRRPARRPDRRTRSGIAARVRRGRPGGA

SEQ ID NO: 31596 - protein, 523 aa, Pseudomonas aeruginosa
DCKEVEMTTNPLLATLIPLVADLSRDLPEDERYRRLLQALRDLLPCDATALLRLDGEYLIPLAVDGLSPDTLGRRFRVGEHPRLEALLERRGPTRFPADCGLPDPYDGLVEGLHGHLEIHDCLGCPLYLDDQPWGLLTLDTLDPSRFASADLDTLEAFASLAAATVKASERMRDLTRRAEDEHQRAEAYLEAAGERPREMIGQSAAHKALLEEIRLVANSDLSVLITGETGVGKELVAQSIHRHSMRSGKPMISLNCAALPETLVESELFGHVRGAFSGAVNERRGKFELADGGSLFLDEVGELPLAVQAKLLRVLQSGQLQRVGSDREHRVDVRLIAATNRDLAEEVRAGRFRADLYHRLSVYPLRVPPLRERGRDILLLAGYFLEENRPRLGLRSLRLDHEAQAALLDYRWPGNVRELEHLVGRASLKALGHNPERSRIVTLHRQDLDLPAETPAPPRSVVEPAPAAPTTGHSLRAATDAYQRRLIQDCLARHQGSWASAARELGLDRANLARLARRLQLR

SEQ ID NO: 31597 - protein, 442 aa, Pseudomonas aeruginosa
SPVVQLCSYGFHFTSHPTSRGIDTRHSKHHVVGAGNRQYHAGNDQAEHRADQQDRQRLDQYQGLFHSRLPGLSIERRQALQHLRELPGSLSNPHQARTDGRDRLALLQRCRQGDAGPHILGDSLQGPALPGNADASGGKQQGLHQRHTISQQGSKHLRPLRYFRLHQPFPDYGQAHQLVERMGAERRIAQRHGDAASKQQDGERQQAGTLVAPYPDAQHCPGKPRELGSLVQEIGEFRNDEDEQGRHGEHPAEHQNRRVDQRPLQLGAGSPFVFHLRGTVPQGSCEVSGHLAGRHQLIYIARQVEAGALQHHGKGLPLAQAIGHRLQGGNQLRVARASLLSLHRVGHAHSRREHGGQLVDGHVQFLGLEPTSRAQVAAFHLQAERGEPLALQLPQRILARWEAEFATNAPALAIDGLVDEIHGLSRWSRDAPRQDWSYPTRP

SEQ ID NO: 31598 - protein, 416 aa, Pseudomonas aeruginosa
TACVRAACWCPSALPPACRQPSKSPPSTPRVRYSSPVPRSPPTPPTRRNTGYARRLCCAPMQTVSFSPGSGGATRWPRRPWRIPICWRDARKARWYSCPDPPARGACMQPFDSRQADEVATLLALAEHGSFAAAGRALQRHPSVLSKRLGALERRLGIRLVERTTRQLRFTDEGERLASRFRQAVDLLDEAEHEASLGAAQLRGRLRIALPSAMGRLWLGPLLAEFALAHPQVVLETDYSERFVDIIAEGFDLAIRVGELADSRLVARRLCAHRRILGAAPDYLKRHGVPRIPADLAAHNCLGFSGLHSYPEWKLTRQDEQQPVRVRGSMVSNDNEALLCAARQGLGIFAAGEWLMSRDLEAGRLVRVLPEWQLDADAGVYLVRPSARYATAAASAFRQWVEARFAAGPPWQRQRA

SEQ ID NO: 31599 - protein, 185 aa, Pseudomonas aeruginosa
SVRKSSASTRTCARWPTCTPKRATWPWSPTCSGGCSRASTWATTKRPSPRPSSCSSASIWTPRWTTSPPVSSTCANARRWSTPGSASSASAWAASWPTSPRRAPTSPARWATTAWASRRCSTRRNRSRAGWCCISPNRTPTARSRPATRSCPACATCPRPSCTSTPASITPSPASAACTSTNRPT

SEQ ID NO: 31600 - protein, 617 aa, Pseudomonas aeruginosa
WRAGQPAKDSASSGRLAAEQGAETRQVDVTAAEQDPDPLAAQFVLALAGGGQAEATGGLDQQLHPRGEEAHAIHQFGVAGGEDVIDVALDQREGEIAQMLGLGAIGEGLRRIDMHDGAAAQRTLAIVAGLRLHPVDPAGRRQRADRQGAAGEQAAAAEGREEGVQRTDFFEQFLGRGALPGQHVGVIVGRDQGQAMALRQVAADLLAIFRIAVIEHYLPAVATGRLDLHRRRVGRHHDGRRDPQQARREGDGLGVVAGGERHHPGGTLLSGKPRQRVEGAAELERSHALQVFAFEEDFRAEFFVEGTRGHHRRAVGMPGDPRGGGDHIVVGRQVVHGRLLGPWQRRQAVRQVTRRTPPAAPARQHRRRKTGGAIDEEALHGSMLRDAGSASLVQVAVPDALRAAVEVEPEAQHDEHAEEHPDGHPGVAEEPFQADIEQRQRYADEGHQQVMLDHCGGHSSSSSFSGHLTICLPVCQAAWVATAFLMVSAWAALRAASLAARLAVLAACPERVLIALADCTTVLPVLSMPGATVPMAAEAPTCFQLMSMHFHLISVRSRSLSQLSFICPSTCLPVCIPSSMPAPSAAPIAARAAKAPITTSGMIRPVGSYAIVGAFSA

SEQ ID NO: 31601 - protein, 832 aa, Pseudomonas aeruginosa
PRAKVKVSGAARAKSTSSGSSLLPSIGLTGLPTNGTQADTRSARPTALLPTCTVGEPVEITPPETFSPTWETGRPLIYPSFLGKSRDRTSARRSTVDIDIGREDLDLPRRQADRALAAAQEDLAVGGQLDALAAEGDALTVQGDLRAIVAAAHAHFVAIAHRQGLLLHHLGALVQPDHGVHHHADVQAVAEPDVFHAPHADVLQRGHEDGFRLVHADPDRLVAVDRLAAVGMHGDGLVVVHGLGAIVLHMHRLVVVDGLGPVVADPVGLVVLDLDVLVPLGMDEQLLGALLVLHADLVEVGRRAALARTALGAALGSVRRQLVGHRLLGVVDPPGDDRPVRVAFEEADDHFLADPRDLDRAPVLPRPGLGDAHPAGAVLVGLVVAVPVEMHLHPAVLVGPDLLALGPDHHRGLRAAHHRHRGRRQGAESLAGVDTVQLALELRAAPAITGLVEFLDYPVLGANHQVFAVLVQARVVAQVEQMARPDTPGASPQANSLVLGLDRLDAGPCIVFAVLTLHILARVVVERVVGRGMGAPDIGAHFQAGAGTLEVVVVEAQRAGLDLARHVPVEEVVALAVAEARRVIGHAGVAGRAVVRAVGIGEHQDVALLFVAEPVVDAFLLHQPADEIEAGLAVLHTVFPLAVGAAQGVLEVGEAEVAEHLLDDVRDLLVLEDAAVGGARQQPQPGPQGDLVAGELAGAGALATARDDAVEIPPAAAGEFQREAHRLAQQGIQRQGGIARDQFELVAEQPAQLFATLQPLQLQDLGSQRGVHVYQAGVLGEQHGESSLIVTCGGRPEQRASSAPDDRTTQCRRERLANSHDTPARLLRTRRP

SEQ ID NO: 31602 - protein, 689 aa, Pseudomonas aeruginosa
DIHERESFSYFNPISPPAAGRRRPAPTRGSRRAFPPARLPRNRLRRWLARTGSRRARSVRPGVAGHHATRPRRPGAAGVAAPRAGHAGDADVGPGRRTGSHQRLHPRRRRLPAEAVQPGRAGCPHRRPAAPRTTGPPAVGAAAGYPAGVRRPGPGCAPPGPSGGADAIRVPPPGDAPRTRWRGAEQAVPLPERAAPQLHAPRPRSRRARLQPAAQTRRGRRPSPADPGGTRPGLPAGGDGTPLMRRHPLLWKLALLQVGFCLLLTWLIYTWGLSVERSTYFLAPADRSYLADYARQAEDAWRSEGAAGAERFRKELSAKEDTWVALVGPHLESLGSTPLSAEESSHLTFMRKLDWPMSRRLQDELPYVSIEFPRHPEQGRLVIQLPERLLPGGLTPWTHLVTHGIVPTLLAALLGLLLYRHLVVPLNRLRDRADALRADELESTPLAAPLAARRDELGELAQALEHMAERLRLSLAQQRLLLRTLSHELRTPLARLRIAHDSELPPEQLRQRLDREIGDMQRLLEDTLDLAWMDTERPQLPTEPVLALSVWEALRDDACFESGWDPARLPCRLGVDCRVEVHLDSLAQAMENLLRNAIRHSPEDGTVSLDGEREGDFWHLRLQDQGPGVAEDQLERIFLPYQRLDDSAGEGFGLGLAIARRAIELQGGRLWASNGKPGLCLHLWLPAAA

SEQ ID NO: 31603 - protein, 478 aa, Pseudomonas aeruginosa
RPSRPSSSRPASAARATFTPATRRTPTATTDVKQMLGHETNRMYRETYSVTHRGEWDFGSSLAYLQYEKTRNSRINEGLAGGTEGIFDPNNAGFYTATLRDLTAHGEVNLPLHLGYEQTLTLGSEWTEQKLDDPSSNTQNTEEGGSIPGLAGKNRSSSSSARIFSLFAEDNIELMPGTMLTPGLRWDHHDIVGDNWSPSLNLSHALTERVTLKAGIARAYKAPNLYQLNPEYLLYSRGQGCYGQSTSCYLRGNDGLKAETSVNKELGIEYSHDGLVAGLTYFRNDYKNKIESGLSPVDHASGGKGDYANAAIYQWENVPKAVVEGLEGTLTLPLADGLKWSNNFTYMLQSKNKETGDVLSVTPRYTLNSMLDWQATDDLSLQATVTWYGKQKPKKYDYHGDRVTGSANDQLSPYAIAGLGGTYRLSKNLSLGAGVDNLFDKRLFRAGNAQGVVGIDGAGAATYNEPGRTFYTSLTASF

SEQ ID NO: 31604 - protein, 269 aa, Pseudomonas aeruginosa
AITRKPDENLPARRRPGPRPGGGPARRRAAGATGPRGDHGPQPAATPGPALSLQRRGPGFRRWPAALPAVARPTAAGTARRRLPGGLDARRQRRRRRPRRVNPETPGRRRRTAAGRHRLPHAAAHRPRRAYLRLHPRESRPGRSARPAQRPAQRWRRRLPRPAARRHAPGRGGAGAPGHRATNPLGTLLRRLAGAPRTVHPSRRVRPLRRGQPVAVVARRGDPRRTSGARTAPARKARGTPALARQRRTGQPARLAESRAGPGDGAAGR

SEQ ID NO: 31605 - protein, 256 aa, Pseudomonas aeruginosa
GKIALRYHRNQRVGRCQRHGAVRRRRVDPHAIDLGLDLLALLAHEPYLAVPALGEHRAPAAEIETGHVFHLAVGNRLDAEQVGGHVIAGRATQGDGVLAGHQGMVAELVGSRAGHVAGGVDIVETEHLEVAVDMQATLGIALARNLPGQGAGPHAHGPDHGLRLDPLAVVERHALGIHRRHRTPQAPLHAQFRRGLGDQAAQVRAHRCADGGAAIDHDHSQRRFLAEDRPQARRHLGGGLDAGEAAAGDHHGVACR

SEQ ID NO: 31606 - protein, 167 aa, Pseudomonas aeruginosa
TMEPGSYQLTMSVLMTPDKANFSGNVHGGALLKLLDEVAFACAKRYAGRYVVTLSVDQVIFREPIHVGELVTFLASVNYTGRTSMEVGVKVMTENIHERTVRHTNSCFFTMVAMDDQRRPVAVRPLEPETAIEKRRYAQALARREQRKLMELRYQEIREQVDHAMPA

SEQ ID NO: 31607 - protein, 192 aa, Pseudomonas aeruginosa
SFIFVLLRGRAARRTGAARPAFTWPDSGRCVRRGSPARAPCAPWCRRSPRPCRRPRNAPWRWPSRRRRYPGGPSRAATPAGPAARSPVPRRPGPCGPWRTCGRRWRCRPRHRPPCRSRSRPRAWRRGRRWCCRPRSTARRPRPSCGPRRPASRARSGRPRSSSRCVRGSSARGTPPAAPDRSGRRSCRFPPW

SEQ ID NO: 31608 - protein, 322 aa, Pseudomonas aeruginosa
FANWPTRASSPYASPTTCSPRNRRKNSPTSRTGPAASSTARAAISSATTAPARCWCSPPPTSRTSSNRALTCRRPWSRSWSQWSATWWSSAGRSACTPPTMNRSRGCSTCSRRSTATFRSTACPGSSTTPRPSPRATSSGCGHSAAASRSRTAWPSRASTSSTATVPRPPRPRRRSSACSPRACRWVPAPTPPGSPATTPGPRCTGWSAVAPSAAWPCIRRACRGKPRCSCSPTAAPGSPASRARKDRSRLASSPTWRRCRRTSSASRKRPSSGSSRCSRWSTARSSMPPPSSTSSVRRRRRCCRTGRRWPRYPATGGKARR

SEQ ID NO: 31609 - protein, 702 aa, Pseudomonas aeruginosa
GGRRLADDLALRQPAERGPGTGRRIAADVLPGPAGRRPRRYRRQAPLPARRAIVDGLGGHPAGQPHPAPVDQRLAAARPDPVHGHRHRADDAGLERHHSGTGGQGRTAGGGGAVQCRGQPGAGGRTGHRRGAGEPGRPLADLRPQRPLLLRGDRRAAGLETRGRALGAAGGTPVRRPARRLALQPQLEATAIGAGARGGVLPRRQRRHVAAAPDRARRTAWQRHGLRPAAGQRRRRRGARRRVPAAPARTPRQRPPDAALQRALRTGAAGPGAAAQPLFAGAGDAAQRRGMDRRALQPAGRRADLRAGLGPRPRAGGLHPGVLRQHGRRRRPVGSGRQPPVDHLRPALRQRRAAARPVRVAALPAAGHRGRGPRAVAALAGTTGRRRGGPGTRPGDGHPRVRHRPAGRRGIPGGDGRGARHASAQRRGVLGAGPGQRQPSPVAGVFHRRILAGTPAPPPAGDPRRVAGRGRRPALPERRRGGAHPPLPARRGQALSLPGDGRRLPLADPPTAVILLADGATRTVAGSDAAHPRRRERNPQGSPRMSYDYEKTSLTLYRAVFKANYDGDVGRYLRPDKELAEAAEVAPLLHPTFDSPNTPGVPARAPDIVAGRDGLYAPDTGGTSVFDRAGVLRRADGDFVIPDGTDIPPDLKVKQDSYNKRLQATHYTIMPAKPMYREVLMGQLDNFVRNAIRRQWEKARGL

SEQ ID NO: 31610 - protein, 226 aa, Pseudomonas aeruginosa
PSNHRPAAPQRTGAALRQAYRIMLETSLFVATLATLGMLSPGPDFFLIIRNAARYQRSAAMMTSLGVILGVATHMAYCVAGLAVLITTTPWLFNALKYTGAVYLIWIGIQALRSRGGGTLDLAVGGVQRVGHWSAFLQGYLCNLLNPKATLFFLAVFTQVLSLDSSFAEKLWYAGIIVGLAALWWPLLVVLIQSAVVRRGLARAQGVVDKLLGGLLIALGVKVALS

SEQ ID NO: 31611 - protein, 429 aa, Pseudomonas aeruginosa
GRRAERRPAAVPAPVCGPAGKSRPFPRFRQRGIKPGCRPALPAPPERRRRTSPSPTLSSADRTPTTMKTRIASLTLLALACGSGATLAADNLKIYNWSEYIAPETVANFAKETGIQATYDVYDSNETLDGKLMTGQSGYDVVFPSNHFMAKQIQAGALKKLDKSQLPNWKNLNPVLLKALEVNDPGNQYGFPYLWGTTGIGYNPAKIKAVLGDDAPLDSWDIFFKPEYMQKLSKCGVAVLDNGPELLPITLNYLGLPHHSQKADDYKQAQAALLKVRPYIRYFHSSKYVSDLANGEICMVVGFSGDILQAATRAKEANNGVEVRYSTPKEGSPLWFDMVSMPVDAPDEKAGYAFMNYLLRPEVMAAISNHVHYANGNLAADPLVDAEIKADPAIYPPQEKMAKLFALESMPQKIDRVRTRTWNTVKTGK

SEQ ID NO: 31612 - protein, 143 aa, Pseudomonas aeruginosa
CSSSARPAERTERVAARPWQSARGFSSARACQPSPRTPAPAPPSHRAPPPARRTPGRPWSAGTCGHRPCAHTPPEPPRPSSSQRSPQLARASSTGCQVLAHVGEAVFVARRSLLVRHLPSARPPPPAGSGGRPVPGGVTPRLA

SEQ ID NO: 31613 - protein, 372 aa, Pseudomonas aeruginosa
PAHARSHARPGVVGGDRRGHDRDRAPRRLRAAGGEPVRKGRGDLLQPGIPAQRLPPARAAVPGAPRHPAGSGDPRPPAGSHGRARRERLPAVAPGPEARAQGILGGFPRRRGDPPQGHEIRAGPALPYPRPDPARRHGSGRGDLGHLPTARAEQPQDRCPRRLRRVAAAGRRPPVPGHARQPVRGGLRRNHLRRKLAGRRPSRTADQPAHPRTVAGTGQARPQRATPRSGLPVHPRRRRAAQRHQQYRRARHRLAPPRALRHPAHQPAGRRGAGLRRRRGAARGDPPRRGRGGSGDQRHDAAGQYLPAQRPGPGLPQRRGRGGAPGRGAQRGDRLHPARLPRRHALAQVRAGAPGTAGDARRYERLSQGGRS

SEQ ID NO: 31614 - protein, 178 aa, Pseudomonas aeruginosa
SPPSAPGRRDSGRCSGRPRRRRWNGRHGSPRAPRGAQPPPPRRRRSGPCHGRPRPGWSDRGHGDRGPLRESPRRGRTASAHPSRRNSVASHDGSRSPGRRAAPSPCRRVRRHPSLSRNPCRFSRSVWMQATAPPCGRRPLCKVESRLRCAAWTRKTRPAVAPMRPGEPVDGGEFVARP

SEQ ID NO: 31615 - protein, 262 aa, Pseudomonas aeruginosa
PCESCQSRAARFCMPASHGWLSNSASTVRWLPKAQKKCRNQCRRASSGSVRIARSMLGNSPAGSGGALPSAPRRPRLPICTSKRRSPISQVSTITWSSSAWPQSAESSTWKELEAKLRNASCKPSSALPMPAKASCNWCSSSSSTSTSSRPVFSPAYQVARIAGSRPAGATHSPCTTQSIRWDSNRAARCCETETASMGCPCMVEGAPPRRCPESPARPGETRHRVAQIGTRGATSRSAPAQVAARQPTRLAGSTPPVETSP

SEQ ID NO: 31616 - protein, 147 aa, Pseudomonas aeruginosa
RRPARAERPNALQRSHEMDRFTGGCLCGKVRLVASGRPYRVGLCHCLDCRKHHGALFHASAIFPEEAVSIEGETRDYAGRFFCPQCGSSVFSRSADEIEVSLGALDAPDRFQPTYELWTVRREGWLPAFPLARHYERDREGDGRSEE

SEQ ID NO: 31617 - protein, 145 aa, Pseudomonas aeruginosa
SCAPRTWASTARGKTANGSPTCSPASPSRRCRARSTARSSATSSWFSTARKSSTGSARTSSSSTSSAPTSPSRSSPRWSTAPSPTSASSASSSNWPRRRARRCTTSAWATCPTAAAASATSSKRACSTRCRGHCSTRTRSRASAS

SEQ ID NO: 31618 - protein, 218 aa, Pseudomonas aeruginosa
PWNAAEMELSLSRVHFPVTTLGPGRRLGIWFQGCSIRCPGCISADTWGPGRRRIALARLLADIQPWLEQAEGITVSGGEPFEQFAALLALLGELRQRSRADILVYSGYPLEHLHAQLEQAAGLIDALISDPYQQHAEQSLALRGSDNQRLSLLTELGRARLGGYQRPLREDDKALDLMFDHDGSVWMAGIPRRDDLLRLQDLLREQGHQLSVSAHRPR

SEQ ID NO: 31619 - protein, 152 aa, Pseudomonas aeruginosa
ICARSSASAWPTGCRCSATPRQGSRAVATACWRRPSRSNGNCASSTSNGMRRCCRRPSPCSKRTTSNASRPTPARCSRHAPGWLGSTRCACCGAAACGASCASTARPTTTAAWPPSSAPATWSASGGRCAGNWRRCNRAWGWRQSPPMPVRN

SEQ ID NO: 31620 - protein, 258 aa, Pseudomonas aeruginosa
SPRCRSATSPTCSAPSARRAARATTCKATWNTPAHCPPASSPVPANCSSACTPTAATSAASTTSDTTASARSSASTSARWAGPPHPPAKATPSASTSPSRTRPPASTPSASNATPPATRCWNAPAPGKSGDPRCCGGRSRTSTGFPPRAGTTTATTNAHGCAPPSRRPWRPARKPIPRQQRRPPNERTESCKNRHPGRSHRHLRARPATPGQGPRALGKPGQPARPAQRRRARRRPRPPRQPARPGSNRNAGWTCNYR

SEQ ID NO: 31621 - protein, 254 aa, Pseudomonas aeruginosa
RPTKRPSPWNSGAPASNRTPRANSAWRASTGTSPNCNCCKARPAPKRSSSDWHAPKPNSARSAATCCSTAWSSTSPRPPANTSSNASAWNTCKTSPAKSPPSAPPNTPNCSSAPPPASPTEIRSNSPNSPSDATPSSPPTSSNRPPSPAARPCSRASPASATKSAKAWPPPGRRPAGSSCANPPPPATAWKSAARPTTAACNCAPSPSTPTATASATATSKPSGAASSNASRPCSPPRAANSAWNARWGWEKWR

SEQ ID NO: 31622 - protein, 91 aa, Pseudomonas aeruginosa
ASNDVRFPPSSNERPRPWCWTKATAISTPAVRLGVVDSALRRWMKQLQQERDGVTPKSKALTPEQQKIQELEARINRLERQKAILKRLPLS

SEQ ID NO: 31623 - protein, 140 aa, Pseudomonas aeruginosa
TGHVERPDIPNRLNREFATEHPNQVWCGDITYVWAQGRWHYLAAVLDLHTRRVIGWAFSAKPDAELVIKALDMAYEQRGKPQQVLFHSDQGSQYASRLFRQRLWRYRMQQSMSRRGNCWDNSPMERLFRSLKSEWVPSTG

SEQ ID NO: 31624 - protein, 86 aa, Pseudomonas aeruginosa
VRAYHYLLATKIAPLGNAANNDRHFIESGDRPMIGVDLFALSHANKLLATYQTACNVLSPQSRAIRFDCIKVRWGLRGLRKQTADC

SEQ ID NO: 31625 - protein, 355 aa, Pseudomonas aeruginosa
RGIEPFFQRRDDVLRRAIDFIVIKSARWMLPGQADGKAFSMRINAFTVIHIKQPEVRQPFAGRRTDLCQDVLCRHVLIHQQRQVAAHFGEARQLAELRQVTVDHFGQQQLEEEHRLLEVEFLRQFRMQRAQVADQPPVPLDARGLPRVQRRVLTGHEAEVAEGAGTGQHCLDIGLGVEEVHAVTAVGPAFRQALAADGAGEHGFLLQAFQLTDEAQAAFEQADPRLLAVEVVLQRLDQARPEAGTHRRHVGGDRVGQGQRLGARIEQFEQGRIDEAEGDRFLIAAGDQQAPQQRQRGARFRLVVRRQARLRVAHRQAVVAVETGQFLDQVDFQGNVEAMARYADRPLPFPVGYHR

SEQ ID NO: 31626 - protein, 503 aa, Pseudomonas aeruginosa
FQGLQQAHDLGGVQRHAEHLGHALGAQGDRRDLRQVRFADLLDDRPRFTADDVEDQARRALHGLARQLAVDAALEAMRGVGVQAIGAGLAGQGDGVEERGFEEQVASAVADAAVLAAHHPGDGQGALVVGDHQGVGAQGDFLAVEQDQLLAVLGHAHAHAAVDLGKVEGMHRLAQFDHHVVGDVDHRIDTANVGTAQALDHPQRGRPAQVDVADHPAEVARAGSRRGELDRTGLVVLRGDRVHRHRRQRYVVDGADFAGQAGERQAVTAVRGQADLDGVVVQLQVGADVLADRRVGRQLEQTGVLFADLQFLGRAEHAEGLDATQLGFLDLEVARQFGADHGEGNLQARAHVGRAADDLEGLAAVADLADAQLVGVRMLFGREHLADHHAAEGAGDRQVGVDLEADHGQASDQLVMGNLRICPAPQPLFTEFHPVLLRNPVAFWPSGIVRGSADRYRRTDAGRSPRSAAWPGARRPCRRRSPGISRDRCWTCAARSGAPCRNP

SEQ ID NO: 31627 - protein, 112 aa, Pseudomonas aeruginosa
RSIPTPVSHFIPDADPNDLASFCASLPKRRTGRPALAFPSDTSGGRSILAQPPRSFTLALSPALPEVSARIPDEPFSPPCSSAGRAPADDAGCRPHPPAGSPPPGPGHGARR

SEQ ID NO: 31628 - protein, 415 aa, Pseudomonas aeruginosa
DHSKSITYENTQRSGPCKLQDRAKCIMRFASRLSRKTAAGPAHRSRAPGTAPLPPATARPPDSRTAAGPAAPAIRCVRRRCWLSRSRPDSRCPRATRWRAVRTRQNACRTPASLPSEKSSQCNQAGRRSASQVGQRLALLVAQGQDPATPLGDQHGVLVLGRQAAVAGGHGPAVLVQLHRVAALVDHRFDGEGHPGLQPRTRASATEVQDLRRLVHLAADAMPAVFADHRITVGFGVTLDGMPDIAEGGVRAHHADRPVQAFAGDVEQLLRLAVDGADPVHLAAVAEIAVLDHRDVDVDDIAVAEDLLRRRPAMTDHLVDRGVHRERIAVLPLAAGNRREGVDDVALAEAVDLCRADAWPHHLVEGFEDFRGERAGHAHALDFLRALDHPEILAASCSRRSLSRASSINWRSTCA

SEQ ID NO: 31629 - protein, 497 aa, Pseudomonas aeruginosa
RRLPGGQGSQFSSFGASARHRKNPQNARRITMSRTLRSWQNSCITKALEHFTVTPHFFCQATPGAGKTRMAAELASRLLEEGRIDLVLCFAPSCQVVEGFRSTFAEVLGRRLDGQIGAVGAAYTYQAMEYRDEGFWQLLDDYRVLVVFDEIHHCAGHDPLLSNAWGQQILHRIQDRAAFTLALSGTPWRSDDKAIALARYSSPEGHLICDYRYGLKDAIADGVCRSPRIVLLDNQKVKLTEELGADSSVRLFPSIAKLLGESPVTYEELLRHDEVINPILDLGCSKLSELRKIKPDSAGLVVATDIEHAQQIALALEAMGEEYRIVTNKTPDAQQVINGFRSSTCRWIVAVGMISEGTDIPRLQVCCYLSRIRTELHYRQVMGRVLRRTGESDDQAWLFMLAEPTLQGFAERIADDLPDDLAVLSDVLMPSLATGSRPEPIGDFDHIEGIHGAGLGDAESDNGLQAANVISLGGFGAEPAYQVSFSQHYRQQLLACF

SEQ ID NO: 31630 - protein, 168 aa, Pseudomonas aeruginosa
PLIESAQVDLAKSFERQATLLDVIAGRVEEPGTKRSQHSGTAIIGRAPPKPHDDSLRARIQGLLDQLTGSEGGRARSVAFRGQNQVNATGCRHFNHSGARLVKPAPSRLDFRPKWSLDGTDPPLSTGGSQNGVDGALTAVCHGHAHDFSVWSRIPHSLSNGFCNELCR

SEQ ID NO: 31631 - protein, 79 aa, Pseudomonas aeruginosa
ALEAGSHNRGAHGYMAAQHFRHEKECSLGIPALCETEQVSWRENGVFDFDLEEPSLELGAYGRWYYDIFHECFLVWHEG

SEQ ID NO: 31632 - protein, 100 aa, Pseudomonas aeruginosa
SPNAEGLPHSSVQEHCAAPKAVFAPGAITIIPALLLESRTLLNAAKWYQTSSLTTYQVATGTATVMAFTLMFGIQSLTGSARPSLLVAKIPGRFTPVCRV

SEQ ID NO: 31633 - protein, 338 aa, Pseudomonas aeruginosa
LFNGHISHRPGLGDRSPAALLAERRAEQLREARQHLPARRSRPAQPGAEHRRGQRRPQQLRLRLAAAETPAIWRLPDGGGLQGAQGDATPADPRDDRPHLLLHERPLRPAPVEAGSPALQRLAQAVPATDLGAPAQPHGRLRDGLGQSLCRPGGPGDLQQPILASTLTSAGVAHDLPHPRPVAALRRPGVRRRRRGAPLRLHGGGDTRRRQPGLPPARREQGAAHPAQCRRATGRRALASARPGSPGRHAARQIGDHPRARPRRALPHPRRGLGHPGRLPHLRTYPGCRAGPADHWPGQLARRAGQRPDGRGARPVPVRRGRSAGAQGWPVATARRRS

SEQ ID NO: 31634 - protein, 453 aa, Pseudomonas aeruginosa
AAARVWCEPRSGRRRPATATTARRRGGSCWTTGTRERQRRFSSGRQTWCAPFLRSWTEARRAAGRRSLANGCDRMMTPATNQFARRGVPERTRRISPNGKCLAASGHRWSIVIGTHTARRWNVPYGLSGNRPVRPGQAHSERVPRGRHADLRLGPRLSDAVLAISVPAGADHPRRLPAPAGVLRLAARAGGVAAAARGDGSGQPGDRPVAAAERRPAVDRYRGGAVDLLGGHPLDDDRAQRRLRREGEPPGMEALLPVDPLHPRHRPVVAGGGRPDGHRAAGDRLDRRPGRSGTVPGDALDLAALASCGVPADARGGAVLLSGAGCRAAFPLHHSRLGALGDRLDRRVPRLWLLREELRQLQRHVRQHRGDHHPPAVLLPVGGSGAVRRRAERGDRTPFGRRQGPWRARTSGQRRPRTQGLSRASASLTLALPVARRYRHSSRPWRPCMCGCG

SEQ ID NO: 31635 - protein, 386 aa, Pseudomonas aeruginosa
QNHPSLLIMAMPVSDPMPLRHLARPRPVSHARLDGEPPRLQPLAPGNEERHEPKRPAPRRSEPADRVRDSDARTQRDPRRRETVPRPAGHQRRAVAPAHAVRRPAVRPYRTQHGAHRASPGNLRPPVAGAGLHLHRHEPRQRVRSGDQHRGVPHRPFRRRRVRPVAAPAPPPARGGAGDRPRRAPRQLSIDAEPAGLGGDLGGRQLHRRTAGQRQAQDRAPQQAEDPPRRLRARPTDPRRLLRATARAGVLRRRPQRLRRRGTGEIRPQAQGGPGGAAVQRPRHPPGRHRHHRHRARLRRPGADRRRRPTRRGPTVRDPGLRTVDGLARRPGQRSGRTLAALADQHVHRRSGQSLSPPAATRTRRRNGKIDRAPRVCGLFHRKHCP

SEQ ID NO: 31636 - protein, 455 aa, Pseudomonas aeruginosa
PSTVTENEKPCITVRDNQNLVVRLVPCRSSPQTSPIPKNRLAESSMEQSSHFSWRYPLALAAVLVLSACGKAPETTQGMAAPKVSVAEVIEQPLNEWDEFTGRLEAPESVELRPRVSGYIDRVAFHEGALVKKGDLLFQIDPRPFEAEVKRLEAQVQQARAAQARSVNEAQRGERLRASNAISAEFADARTTAAQEAKAAVAATQAQLDAARLNLSFTRITAPIDGRVSRAEVTAGNLVNSGETLLTTLVSTDKVYAYFDADERVFLKYVELARQAGRDTRSESPVYLGLSSEDGNPHLGRLDFLDNQVNPRTGTIRGRAVFDNAKGEFTPGLNVRLKLVGSKTYAATLIKDEAVGTDLGKKFVLVLDGDNKTVYRTVEMGPKLEGLRIVRSGLSKGDRIVVNGLQRVRPGMQVDPQKVEMASADTLATLARLRQSVGDSEPPKVAASKDNATRN

SEQ ID NO: 31637 - protein, 1065 aa, Pseudomonas aeruginosa
EEPMNFSQFFIQRPIFAAVLSLLILIGGAISLFQLPISEYPEVVPPTVVVRANFPGANPKVIGETVASPLEQAITGVENMLYMSSQSTSDGKLTLTITFALGTDLDNAQVQVQNRVTRTEPKLPEEVTRLGITVDKASPDLTMVVHLTSPDNRYDMLYLSNYAVLNVKDELARLDGVGDVQLFGLGDYSLRVWLDPNKVASRNLTATDVVNAIREQNRQVAAGTLGAPPAPSDTSFQLSINTQGRLVTEEEFENIIIRAGANGEITRLRDIARVELGSNQYALRSLLNNKPAVAIPIFQRPGSNAIEISNLVREKMAELKHSFPQGMDYSIVYDPTIFVRGSIEAVVHTLFEALVLVVLVVILFLQTWRASIIPLAAVPVSLIGTFAVMHMLGFSLNALSLFGLVLAIGIVVDDAIVVVENVERNIGLGLKPVEATKRAMREVTGPIIATALVLCAVFIPTAFISGLTGQFYRQFALTIAISTVISAFNSLTLSPALAAVLLKGHHEPKDRFSVFLDKLLGSWLFRPFNRFFDRASHGYVGTVNRVLRGSSIALLVYGGLMVLTYFGFSSTPTGFVPQQDKQYLVAFAQLPDAASLDRTEAVIKQMSEIALAQPGVADSVAFPGLSINGFTNSPNSGIVFTPLKPFDERKDPSQSAGAIAAALNAKYADIQDAYIAIFPPPPVQGLGTIGGFRLQIEDRGNQGYEELFKQTQNIITKARALPELEPSSVFSSYQVNVPQIDADIDREKAKTHGVAISDIFDTLQVYLGSLYANDFNRFGRTYQVNVQAEQQFRLEPEQIGQLKVRNNLGEMVPLASFIKVSDTSGPDRVMHYNGFITAELNGAPAAGYSSGQAQAAIEKLLKEELPNGMTYEWTELTYQQILAGNTALFVFPLCVLLAFLVLAAQYESWSLPLAVILIVPMTLLSAITGVILAGSDNNIFTQIGLIVLVGLACKNAILIVEFAKDKQEEGMDRVAAVLEACRLRLRPILMTSIAFIMGVVPLVISTGAGAEMRHAMGVAVFSGMIGVTFFGLLLTPVFYVLIRRFVENREARRAANDKGLPEVHA

SEQ ID NO: 31638 - protein, 253 aa, Pseudomonas aeruginosa
QWTFRRATCRRSPRPCRSAIPANCCAAGRTSAPPNGAWPPAPPTSAWPPPTCSRGSASAASSASPPGGARRSAQAPPAPGASARASVGPPSTSAACVPACAAPRPTPTPRWPATNSRCCWPWKNRRMPSATMASARSAWSRWSASRKPAAPPRNRRRSATAKAPPISWCCWTPNASNSPPKMPRPRPRSSCTAASWRSTAPSAVAGNPAPEPAIPRPMEIGHSSPAIAAPGRGAFLCAARGLGRAPRRFSAMA

SEQ ID NO: 31639 - protein, 496 aa, Pseudomonas aeruginosa
RLGGHCRGLFPPLRLRGVDIQGVGIRRPGRARQVEGMTDGAAMVGAMVDDMEEDLLARHAAVAAIGEAEAQPFAATLQRQLGDIAGEPGGRILQPATQDVVARHHLAVGLLVGRRLAQQARPEQFLDDRHVIELLQGEGQRGRERLGVDPGDGIEGAAVGPGLVIEGLDQQVDLQGGSGHVAGFRVHSLREPDHSPETALNARPATLPGAHRRGRASGRGGAPGAVQLGPRVERQLQASDGREAGLRAKQEMLGPDAAQRQQADPQSGADRGHQAGQAGAGIADAPATPDALQGMDHLLAIQRADREHHQRHRLLRRTLAERPRGAAEPAQRLGPACMAVAVGPPLLDQQQVQLAAAIEAQQVMAETALDLQAQSRTLFGEARQHRHQHFAGEVFRHAEAQHAVAMGRAEGLAGLVREPQQAPRVSKQTLAFLGRQNLPLAAVEQAATEVLFEADDLLADGGLGQVQVFAGAGEVAGVDNADEGTEQDQIEHAHSH

SEQ ID NO: 31640 - protein, 209 aa, Pseudomonas aeruginosa
RRSAPPGDSAPADRRRRRRQPGRCRRRQPDGPRPPARPGRDRAAAAGRRRPMKAKEKDMSDEIFMREAIALARANVEAGGRPFGAVLVRDGRVLARGVNQIHETHDPSAHAELQAIRQASQALGSPRLDGCVIYASGHPCPMCLAAMHLCGIQAAWFAYSNEDGEAFGLSTATLYAEMARPPQRQSLPLRALRPAGEEGLYRQWRQRQA

SEQ ID NO: 31641 - protein, 362 aa, Pseudomonas aeruginosa
PGSRLRRPPPPVLFQRTVLSGQRRLPRPLGLDRTRARAGGGSRGRRRPRLERQAGLPAVRWLRVPGAALRLRRTRPRAWRGNRLEPRPAAGLGRTPAPGFGDAPGRRRRRAVPPAVLRTGPVRRRERLRRGRRATGSAGRPGGRWGARQGAEGPPGSPAAPAHPRLAAGPRRRQPGRRAKAASTGPGRSCARRRHRPAATPARCRLRLRRNLARTRRCAGGLPRPRAPGGRQMAARPGRRGAPGQPADWRRAPRCGPGRTPVAARRDLRPEYGAPRPAIRRRRRRADHGATAAGGVAGEGQRPASGPRQPRRARAQRRQAGQVGKDGQQPQSRRLPGPGRAPGALPRRAARLRLNPPVPAPR

SEQ ID NO: 31642 - protein, 592 aa, Pseudomonas aeruginosa
RFPRRRPDRWSPRPVCRRCRDGGQRSHWRPPRSTRPCRLPLGWLRGARSLGCHGHAGARAAWVEWRGRGSGRGAHRQVEAMPGQEPPFGPPTQRKVAAPPRSRQQRAVAERRPGRGGGAPSEDLQRVFDDQADFVEVRLEAVGAHGGLAHAERQVLGRATLHHVLDLHVAFPAALVGQRVAVGVGAHVDAVGIRIIGVPALAIAGHEAQPRHAEGGHVEVVAEHQRAFLGRVEVAVLDRVVQVDGVGLAQVVEVVVAVVALVRQQHLVRTVGEAAAHAPDVVVEFAHHLPALVLDLVVVGAAEQGQLVVQRIVEAGAGVVLVPGVLLAAAVEADAPVLGGLVVAAGVGDPRRVDAPAGVEAVEVVAAAGAVRLGHRVQLAGLQGQALRQAVVDQGEATEAGGEQPAVAVLDYRGFREHVADPQHGAIPAQLDRAAGSRIVVLRPPLVVIGQQVDATAGAGTPAAAVQAHAELGEGVDADAQRALGEARGKVGHEALHPLLGVAAARRARLALAEVAVEVEVAQQQVDLAALDETFLAPLGVLLGDGRGHQSGAQQQWKRPQSFLSIPLHGDCSRSVHVCFSSAAMPCGAGCA

SEQ ID NO: 31643 - protein, 379 aa, Pseudomonas aeruginosa
GASHGAFFYPPSRLAEEGGMVASDQPPSPFPALLLQCPRPLAAALGGGRRAGLELEVEIQFGEASALHAAVAGRGGVVVEAQVADQPIAGGIGEVVPQVAVARQVDLGGQVAMAGRRDEEVNVRRPLAVAAEAVEQFLGRAVAWATVAGRHDAARTVAAVGVGADAPAQVVFGLAAVEVGIGALGIGVPDIDDGPGQRLAVGTADAALEEHHGAGVAAVVHPCLAIAQRRAGDVQRPFDGARRAAGEAGLGVLGVEQQVQVMLQAQPGGQQAGLLAAAQAVQVVHRFPEFVGRDLHLFDQLRRVVEDAPHQGLGARIAAFVELAAGLFEEALDVGSLGNLHGHGVCLCLLLSGVGRESQRSSAWIDEGCRQSPSISMSM

SEQ ID NO: 31644 - protein, 518 aa, Pseudomonas aeruginosa
CPAIRQRCRQLPSRWRRWAISFSSALSRSACCGSMSTGNFTVIFTWNSIGRFSSVCGTASAPAEARQALLVERQAETRRTRHVQVEILVAWRLEEDVLGQQQRAEQFAVPGQAVEGDEGVGGGQGADAALEHGPAVQADPGRLGDRRATQHRARSAVLGDLQGEHRGGALASQMEGILDALDGLVGHDRRAAAAAQARQADAVVAGNGLFDQGDAVVAERRAGTLGNAFVPGLVDVHPHAGALAEGALDGDRVGHVGIHLTGADLQLEMPVAAQVEHPLGFLDVAAGVAAGQGPGHLQAVVQAAAEQFADGQAEALAMGVEQGGLDRRAGEGVAPDVSVQALHRGIHVVRRLAQQQRGEMRVEIALDALRALAAVGQATDGGGFAEALDAVAATQAEDHQGLPVHGVHGQLVRADGRQVDDDRLEALDHGLAHSRGSTRVAVGFSTVRCSRLARYRAGFAVVSAKHPSPSSLGSNIIFLSNHTLEVSWSFVTCATSRRWPGPSTSPAPPSSCTSPSHR

SEQ ID NO: 31645 - protein, 655 aa, Pseudomonas aeruginosa
PKPGASSTNRARRSWTNWKASATAPGGSGQGQRQWFGIGFVPSALYGVLPELIRHLLGDPELELGLLEMTTLQQVEALKSGRIDIGFGRIRHRRPGDPPERAQRRAAGRRPARRAPVARPAAELGAPVARAVRALPRPAAAEIRRPRAGAVRHPRPEPARDAMGQRDADRHRPGRRRTRRDPGAGLGAVAAPRRRRLPGPGRRLPDLADHRQPAPGRRLPAPAALPGADRPRGRLNALSGAPRSAALGHARGFLEALAVVHGEASEVAEAPAQGDRRDAAGAAAGEDFLAHRGEPVVLQVAHRRHPEVATEALEQLEPRDPGGAFHVLQAQGLAGVGLEKLAGAQQVVRRAPAKALLQGLAVVVRLGQDQSLDQRAFQVAAEKRLGVEFAARHLLADVPHGAPPGRGGAIQGIHLRIEAQGRIDRPLQHLLQDLAHRRAADHHLQLAAVPGDAQLLALVGRDDHPAADVGEQAQPAPAQLLLAAERQAQAVGVERRGILDGDGDVGTVADVAKGGAHRLQHVAVVLELHQSRARRFEPVRPADLRHPGTGGGQVQVVGMEIATIGDGMGPHHGSALDTARLGVRSAGALFSAKCKAYAGARPAPRILHYPDSVRRLSGQSVRRKRRSNLGRALREPPGRSSAAADFRDAHRRLSG

SEQ ID NO: 31646 - protein, 635 aa, Pseudomonas aeruginosa
RQRTRVRTHERYPQKPRTVARLCRRLPRLPSRGRHLPHRPGHVHRTGAVRPGDGADLRKELDLRLPRKRTGQAPRLRHPARRTPAADRHPRRQRPVARAGRRLPASRRDPGAGRQGQPVDLHLSVPCLVLQERRPAGEGQGAGRIPGRLRQGHPWPEESAHPELQGLRLRQPGRRRRGRPGGLPRRRPGVPRHAGGAVSQRRAGSVARHLHLHLRRQLEAAEREWPGRLSRQHSALQLRSHRAAPPAGRGRARRRGRHPRLQQARRRRRGHRRRLVLLRQRPQRALQRDAQPRRTPRLRQRDAAAGGGIRPGPRRVDDASPAQPQSLPQPVRHRPDQLAAAHRPPAGLEPYRDRQPVHRRKGRVGRRPGEPDPPVRGLLQRLRDGHARRPGGVPRSPAWLPSPPGALERHLPRPRQVARRRDAEQPGAGYRAAADRHRDHPRRPLRQPARALAALPPRRPGAPGPAREGGDPMNAGLQYRVEQFLYRHAELCDAQDWDGYLAQFDEQCEFHLPQWESEQRYTRDPKREMSLIYYPSRAGLEDRVFRIRTGKAASTVPMPRTLHQIGNVRIAEEGEGLLRVRVNWQTLFQRLDQTGSFFGHATYRLKPHGEAWLIARKHIVLLNDRIDSVLDFYHL

SEQ ID NO: 31647 - protein, 347 aa, Pseudomonas aeruginosa
TAGPVTMNHKVALSFADGKTLFLPVGHDDLLLDAALRHGINLPLDCREGVCGTCMGRCEAGSYSLDYADEDTLSAADLEQRKVLACQTRVRSDAAFYFDFASTLCHAAAAQAHSGVVRELRLLSEDTALLRLDAGAAGRQLDFLPGQYARLQVPGSDCRRAYSFANRPNPQNHLQFLIRLLPGGAMSDYLRQGCRVGDEIRFEAPLGTFYLRQVERPLLLVAGGTGLSAFLGMLDELAERGCDRAVHLYYGVRRAADLCELQRIAGYAERLPGFRFVPVLSRGGRRLGRPARLPALAFRRRPPARRSFRPLPVRAAADGRGGPPVACASAPLEHLRLYLEKFTESGD

SEQ ID NO: 31648 - protein, 604 aa, Pseudomonas aeruginosa
RSRSAVRHRQASPASSWTSSERSTATTRAPSSSRRRTTPRPIPWAAPLTRATLSRNLSFMGISLARSGSGRAGGELFVVEIRRAHALLAQVALDRLDHRRRPAQVDVDVALVQVLRGDVLGHVALARIVAVGAGHARAPGEAGNPFGERLQALETDQVDVVGHPVDQVQRVRAALFGDPFEHRGERRQAGAAGQHQQWPVNLAQVETAQRAVHRQAVAGPGRATEEAAHQPAGDVADQEADLAVLRQRAEGVGAALLAAGYLEVDVLPGQERQAGQRLAAQRQADGARRELPDFADARLVARLAGPAQGRGRRHAQHAVAFGAHLAGQHVAAGGFLGAEGIVDVVLAQRIAPGLGQALAGAAGAVAAVQGDVDALAVGRVGHGLAGRGMDEAGHPVFEVECDPMVHGMSLDSPPARASDVVDVDQLANVVVLQDHFLGLDQRTLAAYVEVVEGGAEVAVHGLVAIAQGVPVAARAADAVVLAEQFDVAQVVRGAGVRQGRAGALGADAEYPVLQAAAVAVPDQRDFPLRVLGELVAVVPGRHPETGVRGVQRQPGVPILVVEIARLAVEEIAQGVVAQAHDATSRSATRCVRSRSRAASSASCQ

SEQ ID NO: 31649 - protein, 1147 aa, Pseudomonas aeruginosa
ARRHSWAGHSGCYRCCYRRAAPSAGRGTSTHTTQALRRRQSGPAIACGNRTESVQRPTKKGRQGFPCRPACAPASAGRRRLLARSGVAPVGPAIEHRQHQQGQHGRGQDAADHHRRQRPLHLGAGAGGQGHRHETEGRHQGGHQHRTQAGDGALPHRLVEAASFLQQVADEGDHHQAVEHRHPGQGDETHRRRDRQRYPAQPQGQHPAGEGEGDAGEHQQAVLDVVEHGEEQGEHQQQRHRHHYLQALGGGLQLFELAAPGGPVAGRDLHPVLQLLLRFQHERADVAAAHVGADHDAPLAVLPADLVRSRREVEARHVRQRDEVDPRQVVRRQRDQQVGQCRQVGAQGFRQADDDVEAAVALEQGTGVASAEGGGHGVLDVADIEAEACRLVAVDVHRQHRQAGGLLDLHLGGAVDALQHLGDLLRGVVEHLHVVAEDLHRDVAAHPGDQFVEAQLDRLGELVDAARHLKGRGLQFFQQRLPRLLRVRPLALRLEHHVAVGGVRRHQVGGDLGGPGAGEDPLDLRELAHQLPLQGLLHLDRLGQAGARHPQALHGEVALAEAGNELAAHPRGHQPGEQDRAEGAADHQRAVPEHPAQRRFVGQTRAAHDEVLLLLDLAGDEQRDRRRDEGHREDHRAEQRGDHGERHRVEHLPLDPGEGEDRQVHHHDDDLAEDQRPARLPGRGEDLVETFRAGQLAAVVGLGVGQAADGVLDDHHGAVDDDAEVQRAEAHQVGADPVADHPGEGEQHRQRDDGGGDQRRADVAEEQEEHRDHQRRAFHQVLLHRGHGLVHQGGAVVDGDRLDPLGQGPVDLLQALADRLGHFPAVLADQHEHRAEHHFAAVLGGRAGAQLLAQADLGDVADTDRHAVDVGNDDPADIVHVLDLARRADQQLLAAPLDVAGADVLVVAQHSVLQVAEGQLVGRELLRIRGDEELLGVAADGVDLGHALHVAQLRTDDPVLDGAQVGGRVGAAVLLGRALLGLHRPQVDLAETGGDRPEGRRDVFRQLLARRAQAFVDLLAGEVNIGALLEDHRHLGNPRPRQRTGFLQTRQAGHDGLHRVGDPLLHFQRRVAGGGGIDLHLDVGDVRDRVDGQLLVAADADPGHPQHRQQDQPALLDGELDDAFEHAKTPGAGLSDRVPPSPCPVRI

SEQ ID NO: 31650 - protein, 687 aa, Pseudomonas aeruginosa
SQDCRLPAPGPDRKRLHRRPRQRWHRRPAHGLATPLRTGDPRRQPARHRRLGPAPPPARTQQRAGDDAHRAWQADRQGARPRSRRRRLHGQAVPVPRTAGAGPLAAAPPRPGTDAGRPAGRRPGAGRQPPPGLPRPGADQPDDQGVRPAAPADAAQRRRHHPDADHLADLGHELRQRLQRGGSRHLPPAGEDRRRLRPQADPYHSRRRLRPGSAPMTPPGRLSLRLALLVGALGALLALALGAMAHWNLGRELEARERENLQLKLEQIRHSLEDDLDLRSDPAVQAHALQDQLVAHSGLHLSILDSRSGQPLMSFGDQAAASVAANRALLARLQADARQPVFQSWSTGNDQRLLSIGASMRMKNGTPVQVLLSSERNADERLLDGFLRATLLALPFLLPLIALTAWWVVRAGLEPLNRFRRVAAQVSPQDLSYRIPEQNLPRELDSLARSFNHMLGRLEDGVRQLSQFSDDLAHELRAPICNLLVRNQVLLSQHRDGAAYREALESNAEELERLSRIVTDMLFLVQVDNPAIQAQFGCVALHEQAAKVIDLYEMVAEDKGVELRLSGNGFAHGDNLMIQRAISNLVSNAVRHTPQGGRIDVRIGERAGHTEVRVSNDGPGIPPEYLPHLFERFYRRAGRQTGAQAGTGLGLAIVQSIMAYHGGRAEAESVPQQKTHLRLLFPSTGAA

SEQ ID NO: 31651 - protein, 574 aa, Pseudomonas aeruginosa
PRREGISGNFPDTYSPPHPPPHSSRDADGGVSCKRNSGERHSSGTGSEKNSGRRRQALLDPAEPLVGPLDIGAVPAAAHCRDQLDAGGQAAAEQGQHGAFVAQRGGLVGDHVGVVDGAGLVLVLGQAQCLAGRLQGFALHPALLVEDAQLHQVVLHLAETVEHGLPVGRHGLVVGRLGLVHLGADQAAVEQGHGELRADRPEAVRRADPVAQAAAAVAAGGAQGEVGEIGGLGHADLGVGGNHLAFRRGDVRPPLEQLRRHHCRQVRQLRHARHRRQVELRRRQADQHGDGVLQLGTLVLQVDGLGLGAFQLGAGLGHVGPGDDAGAVFVLGHLQRTLVGRHRVVEQADLFVHHPQLQVVLRQLRLLAEAHRGEVGGAGMQARLVGLQLPAQLAPEVDLPADTEAGRVTVADRTGTTAAAHSGAVGQAHGAVAAALAAAGLAHVAGDRREERRPRAAHQRLGLAELRHRLGQGLVGTFQVHLQVVQGLVAVQLPPGAALEHVARLGAAPAFGFLEFGGHRQVRSLVVGADGAAAEGGDQGQGEQRGGVFHRGVSSAPSVRTPRFWLTQWRRRSR

SEQ ID NO: 31652 - protein, 140 aa, Pseudomonas aeruginosa
WLNADSGTRWPSLPITWTWRRISGLCWYCWSTSITTRYWFSGLKMVDTWRWPKESLSTASTIPTLIPRVAARSRSITRRVCTPLSWESLLTSTSCGSLRIAASTFGAHSRSRVRSSLRRVNSYCALLSRPPRRTSWPALR

SEQ ID NO: 31653 - protein, 269 aa, Pseudomonas aeruginosa
RSMKAAKKRSLRRAWEAPSGRFSGRSIRAQSIGVRVKDTTRDTRIAAERVTANSRNNRPVRPPMSSSGMNTATSESVIDSTVKPTWRAPVIAAWIGGSPSSMRRAMFSTTTMASSTTKPVAMISAISDRLFRLKSHRYMTAKVPISETGTARLGISVARPLRRNRKTTRITSATEISRVSSASSSDARIDGLRSSITFSLTCGPSSSCNTGSCAWMASVASMMLAPGWRVTISSTAGRSSEKPALRTSSTESLTLATSPRRTAAPLSAL

SEQ ID NO: 31654 - protein, 448 aa, Pseudomonas aeruginosa
TGGTGSFSAPATHRVALEAAGAASLRFLRLALEDLRGGLGDTHFHTVAQAVGAFHHHLLAGLQAAFHHHPLVLAGADGDAALADLVVGADHVHIDTVGAALHGVGWNGQHALEGMRQQAHVDELVGEQLAVGVLEARLELDRAGGGVDLVVQGGQGAFGENLVLVAVQRGDRQLAGAVHLLDDGADLLLRQAEHHRDRLDLGDHHQRRGIAAGDQVADVHLAQAEAPGNRCADLGEGQIEAGVVDLALVGTDGALQLADLGFLGIQGLLGDRVLGVQPLVALQVDLGVLQLRLVLHQRALGLGQRRLVGARVDHRQQVAGLDLLPLLEQHLDQLAVDPRLDVHRVEGGDGAKRVEMQRQVALLHPGHADGERVGLGQRGARLAAATGSPVGGRCRGGRRQPHHQADHGGEGQGGDQPRAQGTELGFTGRWSHGSSSGLERRRFFQAAR

SEQ ID NO: 31655 - protein, 181 aa, Pseudomonas aeruginosa
QPDPQFRRPPCRPAGRRRSDRAPRPGRRRAAHRRPGPATAGGAEHPERPLRPAADAGPDDPADPRVDRPPAGAGSHPRRRAQLRRDQLHQDRGLRSLPVRLQPAQRQLRPGNPRGAGQLPPGRRRQPRAQGIPDPRRPPAAPARRRPVATPQRPGGRRQQPRQQLEPRAHRPHGQSQPGAR

SEQ ID NO: 31656 - protein, 555 aa, Pseudomonas aeruginosa
QELRAAGGRYRARGADVLQPLLVDRRRTQQVPVRLRMGPVDRGRRTQGRGEKPQLPGHLRAVLAQPQRGGRRRHLRGARHPLLRQGRAEPGDPCRPRLAGLRIQRCGRIRGRRLMHQRQHFEALAEDLRRHLAEGEDFTLWYSAEDSEFIRFNRARVRQAGRVRQASALLRLIRDERQASLDLTLSGAPEEDRQRLAEGLRQLRQSLAWIPADPYLLLDTTAWQRENQDLGAAPDSGALLASLERQARDLDLVGIYAAGPLFRGFANSWGAFGWHAGSSFNFDWSLFHGNGQAVKADYAGQRWDDEAFARRFEQAREQLGHLGKPLRQLRPGDYRAYLAPAALEEVMQMLCWGGFSARALATGESPLQRLQNGDALLSPLLNLAERPATSPSPAFSAEGSPRAEVELVGNGRLSGRLVSSRSAREYGLVANGAGANEAPTALDMAGGSLEQARILEALDTGLYIGNLWYLNYSDMPAARLTGMTRFATFWVENGQIRAPVSTMRFDDSLYSFLGAHLEDLSHERELRLSSNTYGERQTDSMHLPGALTGRFTLTL

SEQ ID NO: 31657 - protein, 275 aa, Pseudomonas aeruginosa
SYARFESSFVRDPDRPGLQQHPAEPASLRRERRDKRRREAARDLPGFQRKPLRPLRQGQGRHAAGGRALRPLRLRRAGRPGRPVRQAERHPRRMRACLLRLAPAAAIRRRGVHRQGAQTGHGRSLLRLRGRRRPGPGGEGRCRAAGRRGGPRHRAHARRRATRRRADLYLQPEQPDRHPHPARADRQGDRTQARAQRGAGRRGVYPFFRRTQRRWPGHPAPGCAGPAYLLETLRDGRRPARPGHRASAAAGAAGALRRPQRGALADRPRRAGKPA

SEQ ID NO: 31658 - protein, 184 aa, Pseudomonas aeruginosa
QSWDEAGWPWGSESRQGRRVVRLVGDFADQFAVQHLVLLVEHHHGARGQAGQRAAGDGHAIVLEELATAQGRQVDYVLQAFGAAEALLRERQVGGDAQHHGVGQLAGLDVELAHRGGAGRGVDAGEDVQHLALAGEVFQGHVSEVAADQAEGRSLGAFLRELAIDVDRVALESHLSHCVDPSSQ

SEQ ID NO: 31659 - protein, 153 aa, Pseudomonas aeruginosa
PAAGRPGAGRPGWNRAVRRPAARSPRPRAAGRPGDRCCSTAAPVPGSARRTPAGTESPASAPVRPAGRPASARAGCSGRVESSFPPPPGPPAGARNARSRPARRGSGLPGGWCAAATARQGAPPVAGSPGSRWRAAAPGCPRPCRRRPARRCG

SEQ ID NO: 31660 - protein, 162 aa, Pseudomonas aeruginosa
PHPTTGCPGAGRHGWRASRDRAASSSATARPAPRPRRRYGPGGRHRAGSVVRGPWRMPRGGSAGHGRRPGDDRARQGCRGRSRAGCAFPCAGCRDARRSAPAAHDGRRSRPRKSAVGWESGSPVRPLPPARQLRRGRAGRSPRSPWRSAGRCRRRRSAAGRD

SEQ ID NO: 31661 - protein, 573 aa, Pseudomonas aeruginosa
HTFMRYAWSVSAHPSEIALEEQVQRTGQAARRFEIEAFGQLVAQGDGICRFEHSNTIAQAELVGDIPAGDHAGAVAGALGVQLEVLDAELLGDFPGERRATGQAQGQGRLAEHVAVFAGAHRPPQHQVGQRLLLAHRRFGEYRAGRLLGAAGQAQAGDHVVDPADRLDIQVRLVDRSGEKQPRPTDRQALAVCTIAALVQVQLAAGIQVVSDVQVAGQFGAEAEAGERQLVLADLDIDVHLHLQRLLLGLLGADDHRVVGDLDRGWRQLADGDVATRHQDLAGDRQLLPGHADLQVRFHLQLRIGIDHHRQAVATDVQGDVQRVAPAQVAGQAALAVPAAAPAAAEFQAFASDASVEGKVLEAGRQLAAANVAVAQRHPSVDPRRQQAAGQPAAAVQPALQFLHHRHERARHRQVEAGQAELAAQRLARRARVDLRLHPQLAELRSAEVEGGIDAVGRQPALQAQAVVADVDPLALVAQAQRTAAGVQADHAARAAGRNVQLQVAVQLALPGEVLGEPLLQAVQREVAQGVAQPRLGQQALLAAAEAGAAGYPAMCAEIDLAVGQPLQARRLL

SEQ ID NO: 31662 - protein, 481 aa, Pseudomonas aeruginosa
QRPLEPYPEPGFPRIPLLRLPLVGIRRPLADPHGRHAGAAHPGFQHHRREAPAGPGRGPDGRGRPGGYPPYPRRTGKRTPSARQEPRRPPGEGGAIRPRFEHRLRRPPRTPRRTRRGLASRQGQRSSCPGRLRRPAQPICRAGDRHRRTGDHPASGQPAGLAAHRATGGGVRRRGAYLGRTGRQGRRHPPVRSRRAVRHLRHLQGTGAGQSRQKPGQRRPPLRIQRSAGGRGERRSARHRLRRHRVGGPGPRLGHRRRRIAADGAPGKPDRHRGLSAVAPPVPLPEARREEPLGPGPGTFRPGPARPGDRHPQRLRRAEDPGGADRTAPADARRIPQARGTGAAPDGELPLPGRQRAARQQGTARRTAFAGLPAAKSEVAGAHRAGGLRRSQVRRRALGPAFAPARHGRAPRTGPRRREFPRDPRLRRRVAGRPATTRNWADRRTGGWKSGSTERCSHFVTSPFCRRPEPGLFFPSDCGPL

SEQ ID NO: 31663 - protein, 78 aa, Pseudomonas aeruginosa
RPARRKPPSRTRPNRMPNTLWIERLDTHAEPFWRVRLGTRGICFRNERAAREFAALLHSRRAWQLERNAEEKGAESPE

SEQ ID NO: 31664 - protein, 462 aa, Pseudomonas aeruginosa
KRPAPAGLSPIPQPSAAAAQHLPGHVLAQLELADRRAVHLVRAVGQAQGALHGVPVSQREVVGNPGATVHLDRPVDHLQRHVGRHHLDLGDFALGDLVAHGIHHVGGLQGQQARHVDLHPRVGDVVDVAAQARQRLAERGTADRALAHQFEGALGHADGAHAVVDAARAEAPLGDLETAALAEDDVLVGHPHVLEQHFGMAMRRVVVAEHRQRTEDLHPGGVDRYQDHRVLLVARRVRVGQAHEDQDLAARITGAGSPPLAPVDHPVVALALGARLHIGGVGRGHARFGHGEGRADLAAQQRFQPSALLLLAAVAHQHLHVAGIRRGAVEGFRPDQRTAHDFRQRRVFVVGQPGTVLGLGQEQVPQPFGLGLGLQLFHDRRRLPAVALGDLALEHGFGGIDMRFHERADAFTQLLDLGGIGEIHGGYLLTGWQARHRTKALVTMPEQGLRFAQSIFSVHEHS

SEQ ID NO: 31665 - protein, 318 aa, Pseudomonas aeruginosa
WSSRRRRQRRSPRGPWRRPGARSARRPIPRAPACRGSRGRPSRGLPRPGNGARGPSRRRTVSAVPGRTAAPCHGSGSLLRRESSRVPLLHCLHQRKRSTAIAVASPPPMQTAATPRSRSYCCRALSRVTTIRAPDAPIGWPSAQAPPWTLRRSWDRSRSRIAAMPTTAKASLTSNRSTSPSDQPVRCIRRFTAPTGAVGNRFGASANEACPRIAANGASPRRSASERRIRTSAAAPSEIELELAAVTVPPSRNAGFRVGILSSRAFGGCSSLSTRRSVLPTVTVSGTISAWKRPSRMACCARVSEATANSSCASRVKP

SEQ ID NO: 31666 - protein, 147 aa, Pseudomonas aeruginosa
GALDMLSMPPASATPALPASNVSWASISAFMPEPHILFSVEHGVPRASPAPSTAWRAGAWPWPAASTQPSTASSTSSACRRARSTAARTAAAPRVAALTSLKSPRKPPIGVRTALTMTIGSSRVMGSSSCISGRPCGWRRRGESLRR

SEQ ID NO: 31667 - protein, 654 aa, Pseudomonas aeruginosa
PARRVCRAAADRYRRPGGPPPARRPAGATPPALRRPGAPRWCPWYSPESRRRSSPAPLASLRAARHLSAGAGRGSILSIAPLAQREQANLFDADLAHAELLDLAGNGHRELVDELEVARDLEVSDTRLAERPQLFVIGVVARMQLDPGDDFLAIALVGDADHLHVGHRRVSEEELLQFARIDVLAAADDHVLAAPDDPHVAVVVHHRQVAGVHPARRVDGLGGGLGVVPVAEHHAVAAGAQLADLAARHHPARLVDDLALQPRLGASDSGHAQLQAIVRTGLQRHRTGLGHAVGDLHLGHVHVANDPPHHLDRAGGAGHDSGAQAGKVEFAAARMIQLGDEHGRYPVQRGGALLGHGQQGRLGVEAGRRVDHGRAVGDAAEVAHHHAEAVIQRHRDHQAVFRAESEAFADHVAVVEDVVVAEGGALGEAGGTGGVLDVDRLVELQRGLALAQFLGAYRGGQPRQALPVQEARRRPLGQADHAAQFRQALAGQFARTRPRQLRQQVAEHRVVVAGLEGVGADQPTATGLLESVFQLAAAVCRVDVHQDRTDLGAGELGNAPFGAVRRPNPQAFAGAQAQGDEGAGVGIDPLRQLPPAVAQALMPHHQRLALGMTRDGGIEGVADGGRQQGDILATRGIARLIHGFPLLWLFWECR

SEQ ID NO: 31668 - protein, 244 aa, Pseudomonas aeruginosa
NGRFFTGAQHDPGNRHRPGDGPRPRCAGRSRATMATALFRHGHPRDGRTRCGQLLDPAAVARQRSQRDPHGGPGSQRHRFSRRRRDHARRAQRTRPEHCGEHLEHRRDRRTGRQRFHPGGLHDDRADRHRQPVPARSRPGGGPPHLGRGRAGALLPDQRVLRGAQRSAGAHAVAATHGRQPPEPAEPGKPRAERQRQRGSERRGVHPAQGGFAGGTDGRRAVPGTAGHRRQLGDESRRGMNRRI

SEQ ID NO: 31669 - protein, 182 aa, Pseudomonas aeruginosa
PTWRGTHKFHRLAYRYGTSVPIAKSRNPSVFFEFLPLEKVCSAQRFSKSHPARKENPWLNPRTSTPGAQAGPGRTTRRPTTVCAKKPTPLARSCAKAATAAPSTTSCVKPPSISTARPTSTGSRCSATCARKTDQRHAGRLPLSARTPPPLFACSWRRLIRAHPGIAPRPAGETPRCRRPAR

SEQ ID NO: 31670 - protein, 255 aa, Pseudomonas aeruginosa
VRSFDWHNVTFVTEINRSPAEHPCQLFPFVGSGPAPASSSSCQIRCRYSACRNTRHARLAGPQGRPRLPRRSLRAGPTWQSIEAFHAATIPTCANPCPARRQPGGAATHSPGLLRLADRRRTRLPRAARRPRAGGATDRRGQPAIPRPGPGMEERPAARTPGRGPDEILEPVRSPGASGAGHPRAPGQRGRRRVEGSCRAPARRAPATRYGLPTRQATVPRGGRRPHRRRPGGDRHRPCHHRADAGPARRTAPGQ

SEQ ID NO: 31671 - protein, 193 aa, Pseudomonas aeruginosa
SPFLLHQRGGPAHHAARQPGADRRQPGRRPAQPVAGQPQPGPSGATPDRAHRPAQPWRLRRAHRDPAQGRTRQAGPGRQHPARLPGGHLRPAAAQYPRPGQRQRLAERDRQPDGGRYPRAVQPHRPGRHGDAGNVRHRPGSGALRRRRGQGRRRGGRFRPARRRRDGRNDSQHRRDAQGDRPYGGGHPPIGKR

SEQ ID NO: 31672 - protein, 184 aa, Pseudomonas aeruginosa
RQDRQGPRRDPWHRRADQPARSQRGHRSRPRRRCRPWLRGGRRRGPHPGAAHRRVHRRDPPDHRYRAERRGECRARHRKRAVAQRGRCRAGCQRRRHAAPDHRLGRIDPRHEPPDRYRRRGTDRRGRGHFPQPHGNRLDRLQQPGTGGADRSRQPRSPRPLRATGRCPATPAGLTWGKKTTSMR

SEQ ID NO: 31673 - protein, 546 aa, Pseudomonas aeruginosa
PCLPLPATVRTTVASVRSPERLSSSLVFSNAIPRPALSTDCTGRASPLGIPMLQTLKQNWFSNLRGDLLAGLVVALALIPEAIAFSIIAGVDPKIGLYASFSMAVVIAFAGGRPGMISAATGAMALLMVNLVKDHGLQYLLAATLLCGVLQILAGYLRLGSLMRFVSRSVVTGFVNALAILIFMAQLPELTDVGWPVYAMTAAGLAIVYGFPHLPRIGRLLPSPLVCILVLTGISIYLGLDIRTVGDMGQLPDSLPLFLWPDVPLNLDTLLIVLPYSAALAVVGLLESLMTATIVDEMTDTGSDKNRECKGQGLANIATGLLGGMAGCAMIGQSVINVKSGGRSRLSTLMAGVALLLMVVFLSDWVGRIPMAALVAVMIMVSIGTFRWESIRNLKRYPLSTNLVMLVTVGVVLATHNLAFGVVAGVLLASLFFANKIGHYLDIDSERSADGTRRHYQVRGQVFFASSGRFVAAFDLKETLEHVLIDLRHAHLWDVTAVAALDKVVLGFRQRGVQVDVLGLNAASATLVDRFGAYDKPGAVDILPGH

SEQ ID NO: 31674 - protein, 131 aa, Pseudomonas aeruginosa
IPSSVRWAIPFPTTSCSRRATASARNCRISLSTRSARRASDCSCHGSNRKKPSRSASACCGPSKAPSYVAGSRSRPTWASAYYRLPTIPSTAIRTGCAWWSARPTTPATAVSAGPATTRRWTRPSSVPSHC

SEQ ID NO: 31675 - protein, 135 aa, Pseudomonas aeruginosa
CAPSATGCCAMPWPSWRNGTHGTSRSGWRSTYRHRTWKTAASWKRPSDSPKPTTSTFPPSSWNSPKAYSSATPRRSARCCCVPGSLAWASRWTTSAPATATGPTCAICQSPPSSSTNRSPATSPARRRRRASPRR

SEQ ID NO: 31676 - protein, 132 aa, Pseudomonas aeruginosa
DCRPSGGPPVPAKAGRGAAGALPQPTAPIAENRREAHAPRPASGSRDARTAREREYPRLPTASRGRPRHTAHRPGGPSVSAPMPPRRFPPYPPGSPAQAPREAIRPLGFPATTRIHGLDPPAAHRSPASAGS

SEQ ID NO: 31677 - protein, 484 aa, Pseudomonas aeruginosa
SAPPLAQPPRACALVQARLGLCLPEVFRQNSPGGQTLMNDSAPPSNETEIRFSVLLVDDEPLILSSLRRLLRNQPYDLLLAESGEQALQLLESRPVDLVVSDARMPNMDGAALLAEIHRRSPETIRILLTGHADLPTIAKAINEGRIHHYLSKPWNDDELLLTLRQSLEYLHSERERRRLERLTQEQNDRLQQLNATLEKRVQARTAELQQTADMLDLAYEELKRSYVVGTEVFSLLVNQRLPKDKQTNQQIIELVRACCASGLVDESDGRDLAMAAALYNIGKLSWNDTLLSSPSDLLYHHDRDRFRGYPELSESLLMSLEPMQDAARLIRHHQEHWDGSGYPDHLKGEAIPLGSRLLKLAVDFVELQRGLILERRMNRDEALMYIRKYAGRLYDPELIEPFIQVCATTLADVTLADPQVRAHGTRDLVPGMVLARNLTANNGMLLLNAGKVLNLALIEKLIAFEAIEGARYTLFVRLPESTT

SEQ ID NO: 31678 - protein, 146 aa, Pseudomonas aeruginosa
IKGQVLAVLCPSTFSIFHFHPYWPSLAAGRAGPWIPGFPGEAGYPSHQPIGITGYFPLISSRPSLISNPISKQGASRCLTHSSPPSRTAAPSTPWTSNCPSPRRKSSNWSRRPSRTALPRSTRRARGWSSCSAPSTSSSGTSPRTS

SEQ ID NO: 31679 - protein, 199 aa, Pseudomonas aeruginosa
TPAPPDDLSEALRMPTPGTGSVPELQLVPFQLEHFPILQRWFATEKELVQWAGPALRHPLSLEQMHEDLAESRRRPPLRLLWSACRDDQVIGHCQLLFDRRNGVVRLARIVLAPSARGQGLGLPMLEALLAEAFADADIERVELNVYDWNAAARHLYRRAGFREEGLRRSATRVGRERWNVVLMGLLRQEWAAGGAGND

SEQ ID NO: 31680 - protein, 161 aa, Pseudomonas aeruginosa
PSIRGIMPSVITTSKSSPCQRSNASSPSSVEVTRCPRLSNCMVRVSRLNGWSSASNIESALASFRSSTSATPERASLDSLGGGSVSGRSNSTEKQEPLPSSLRRLIWPPIRCTRRRLMYNPRPLPDAWPSAGEPTCENGRNSLAWSSSEIPRPVSLTSSSK

SEQ ID NO: 31681 - protein, 229 aa, Pseudomonas aeruginosa
IYIWSGKRDSNSRPRPWQGRALPTELFPHRLGDGRHSIASRRRVNSLIQKSLFLFRGGRQMRPRGQQVVHHGPQGQRRGDDQQHVAENHPEGHQRRIRQENDQRQHLRRGLPLAQVGHRDLRPRPQFGHPLTQGGNHDLAADDDHRRQGQPQVGVLFHQQDQRNRHHQLVRDRVEEGAERRALAEAPGEVAVQPVGGGGQGEHGTGGQVAPGRRQIEQQNEDRNEQDAQ

SEQ ID NO: 31682 - protein, 922 aa, Pseudomonas aeruginosa
AGILLAVQDGINLLGKLFTDTGGFGQFIDTRPRQFLQPAEMLEQVAPTFRADARDVLQRRRPPCLAAPRTVAGDGETVRFVTYLLDQVQRRRIGRQGELVGGIVQVEGFQPRLAGHALGHAEQDQTGDRQFLEHILGHGQLPLAAIHQENVGHLPLAVLQATEAAGQRLVHRCVVVAGRDAFDVVAAIVRLQRPFRAEHHAGSHGGLAAGVTDIEALQALRRLRQVERLGKGFEACRHMLAVGQACAQGLFGVGHRQLLPAGAGTTHPVADLQFAASRFGDRRNQHREILVRHVDDQLRRQVALLVAEIVLAKERQQHFAHLLLDRDLREEVLAAQHPPAAYADQVYASAARGDDGGDDVDVAVATFHALLVLDPPQDRHLVAQLRRLLEVQAHRRLLHADVQLVGQRVAPSFEEHHRVAHVLGVLLRTDQPHAGPLAALDLVLQAGPRTVAEIAVLALADEKRLLQQVEALADRSRARIGTEVTPLALLRATVQGQPRILVLAGEEHEGIGLVVPQQDVVGRPPLLDQRLLQQQRLGFIGGDGGFHLGDPRHQRSGLRRQAGLAEIAGQALLQALRLAHVEKLGVRIEHAVDARTIAAGSEESACVENGAHLAGGIDHAVADGEQRQLHVAGDRELLEDAVAIGIHGLRRQAQLVGDALHLVAVGDHQGDLDLALGQRIEGGIVLLRLEGLQRQLLGDLRADIALAGEDLANRLDHFLQPRALGHVAGGAGLHEAGGERILFADGDYHDLDVGLAAQQLAGCLQAADTGHLHVHQDDIRLQFAGQFQTVFTAVGLADHLQAFDVGQHAGNTGAYQIVVVDHQHLNHAAPRRALADNRPHGPPGDFGNLNRKPSHDLAWRKGVINQASWKHHSTASNGRCEVYRQPPASGRPDRSKNRRICGEPSDAGPGKAQAPWLPGTPP

SEQ ID NO: 31683 - protein, 402 aa, Pseudomonas aeruginosa
HRVQEVTDEPVRKHPVRFRVATTQQLPRRATHHASGHASGFGCRAAPAQRSALRVDRAERTLPPGRPEPGGALPPFRLRRRRAGIAECRHRGRSLATDQDQHAAVPQGYPRDRGATFQLRHRGCGYRPAGQAGLAAVGPAVSRQRPGVGRLRGVPRPAAGRAGTGPPAPPGKERRRAGIRGVFPGAGVFRRRRHHLHPPRGIARGRDRHCQLRRVPGLAGARQQGLQHPRHPRDGRLPPTHRGTAGGATGPLPEHRLGRPAVEGHRTDAAPTARRRGHQLPGSARPGPPRQGAPTAAGRATAHRGSRREAGLHGYLQFSPRLPSLDGTVRQRLSPGPPRRQDRAAPGRTLAGMIPFRAISADRGERRTGCTQPGKKPRAAPIRPSRSLRRGRTASPAGKRRD

SEQ ID NO: 31684 - protein, 415 aa, Pseudomonas aeruginosa
VVEGAVEADLRGIGVVAQHVAIGGVLRGQLVRTDVEQVVGAGGQRQVGAEPVARGDVGDVLRVVDEMVEFLRRPGVRPYRVVEFRAGPAVARQAQADLPVLAAPGAAEGNLAARGGAGDPGDLLGIEQRLAVGASMVLAQGGAVEVGRQFPVDLPVLAKRDEVVTGDVDTAGAGVGTVGQVMGTDRTGTGRQRDPRRGQGIDGFLAGIGGAVDDAVADADLVGVDVQPDVFPRAEYQAKVEAGRLLRLQFVGAEHLRRRRVGRQQAKGDGRADAEAGVVLLDQGRRAEPAAYAGAQRHPRIELVTGGELAVGGAAEVAEFLVAHRHVDLPGWGQGGTQVQVGRPGVPRPLPLAERREASQGFRPAAVVGRRFAGVDAVAFPPVFRTPATTPGGAARKSSSNSRPRSRLLVHWLLR

SEQ ID NO: 31685 - protein, 390 aa, Pseudomonas aeruginosa
PQVRTTSSGRCKIQLVSFRKGNPMKKVCALALSILTTIGATAADSAWAAQTSVHLYNWYDFIAPETPKAFQKETGTRVVLDTFDSAETAQGKLMVGRSGYDVVVITSNILPGLIKAGVLQELDRDRLPHWKNLDADILGKLQANDPGNRYAVPYLWGTTGIAYDVDKVRKLLGPDAPVDSWDLVFKEENISRLSQCGVATLDSSTELVSIALNYLGLPHNSQNPEDYQKAQELLLKVRPYIRYFDSSRVDTDLSNGNVCVVVGWQGTAYMAQVNNEQAGNGRHIAYSIPREGSLVWAENMVLLKDAPHPQQGYALIDYLLRPEVIARTSNYVGYPNGNQAALPLVERKLRENPAVYLSKETMATLFPLETLPLKVERIRTRVWSRVKTGS

SEQ ID NO: 31686 - protein, 161 aa, Pseudomonas aeruginosa
ASRASATCSAVPTRAVELCPPPTSLAIPVQRRSSRRSPCSTALSRRWAPTLCGLPLGKPASPRRAPALARIASALAQASSSVRPRMGRNDRLNSTSRPFERACSRTAEMVSAACARGSPQSMNTSACLPATFSAASEEPPKYTGMCGFCCGRMAEKACSTR

SEQ ID NO: 31687 - protein, 77 aa, Pseudomonas aeruginosa
ATFLPLRSAMLRTGESFGTSRAMVSGFCRETPTSFTGAPLAARKMKPESPRKPRSSAPACNPSATGAADWKCFHSTW

SEQ ID NO: 31688 - protein, 125 aa, Pseudomonas aeruginosa
YSPSAAATCSGVPTRAVEFQRAPVSRATPVHKRLSSTSPCSAAASRRCEPTFCGWWSRSGRPRRARFSRTCSSTSAARFQAASSVSATIGRNDTEKRGSRPWALAAARTRRICPSTAASGSPQSM

SEQ ID NO: 31689 - protein, 227 aa, Pseudomonas aeruginosa
LRFKMHFRNKKAFATVPPELPGVNPRMSSILRLDRLRQFIGELATLLDSRPDESTLLAQAHPLLAELVRQDDWLPEDCARPDPQRYQQYLLHVDSRQRFSVVSFVWGPGQITPVHDHRVWGLIGMLRGAEYSQPYAFDAGGRPHPSGARRRLEPGEVEALSPRIGDVHQVSNAFSDRTSISIHVYGANIGAVRRAVFSAEGEEKPFISGYSNSRLPNIWDLSKENPA

SEQ ID NO: 31690 - protein, 82 aa, Pseudomonas aeruginosa
APPGWPRWAGRSRYWTDSPTPTSARGAPGARRCRGNPGPTPSTRPPSPTGWANRAPGCSTSPPAPTMRNATSPAPPGYCAAS

SEQ ID NO: 31691 - protein, 331 aa, Pseudomonas aeruginosa
SQRRSAQYLRPAGTHPGLQRPGGLRFAADAPALSERVRGADRLLRPVLPHREAAQQRLGSGQHFRPDRLHGLHARPDPQHVPRPAQRRQRHHFGVRHDRPGVLRPVRLCADHPQGHELPVRLHHRRLLRPAGRRAGIAVLPDQWPATGDQRRLRPVLLGDDPLPDQRDHPRRRTQLHHGHHQPVRVDLQPVHQPVADLRHRRRRRLIENASGKARPRDGLFHLRTGKTQALVYHSKKSFAYRSMKFAIALFDPPHSPAARRALRFSEAALAGGHEIVRLFFYQDGVHSASANVLERARTISTWPARLGASLSSATAWTPWSASPPPCAAAC

SEQ ID NO: 31692 - protein, 130 aa, Pseudomonas aeruginosa
RAPGPRGRGARRPGPARPAATLRPGDYPLMATTLHVLSRSPFNDGRLGSCLYLLNPGDGLLLCGDAVHALLAGSHACQALELMPAEIELFALLEDLQARGIEDVPARLVAVDYPGFVELATRFDKVNSWL

SEQ ID NO: 31693 - protein, 379 aa, Pseudomonas aeruginosa
SSTSPSDWVRTRATACTSTTCSRAPRPSLARSWPACRNRATVYDSLDSRRTSVRPVRPHPRQRQARSAQPDPGGSPRGPRHDPRRQGRGHPAGRLPHAPAAQGGKQRGTGRFHRGGARAPASPVLARRPRLAQLRRQEAPPALVPAGRQVPGRPWRAHPHARRRRAYRRTPVQRTVAGGAGDPALPRLAAGRTGPGARPPGVHSARCLDAGAATHDRSAQYPRPALADPFAGSPAQPPECGLHPAEHLPPRLPGNPPRGQPPARRPGHRHQGRRRRDRSQPGRRRPPVWLRPGRSLGRGMAGIVDAPAHEAGTARPGFPSGRLGRPRRRRLWPPGGALQHGPGATGPWQESRRSLQGSRTLLGDPKRIDLIDTNSPLFI

SEQ ID NO: 31694 - protein, 395 aa, Pseudomonas aeruginosa
HTERRPLPARKRPAPPLAGRAGVPRRGRALPSLCLAGLPLGPSDPDRAQAEGAGVAGRCFGGQLADARERLDLRPRPRLHRRSPRRPGLSAPAKHPRRPALQRPGHGAAAVGQAGAEDRQQRISRYRPHLQQRLRRHRRQRAGLLPGAAARGDRTPQRTHLSGGQQRRVPCWLRHSPGRLRGGLRPVVRGAGLPGRLARRTPLPGRRIPDRGRYPPVHHPGALRCGVPRTLQVQPAAHRRLPESLRLVARAVPTPGHRRDSGLRTYQGALVRQPPHHQPDRDSTAGPASRPGARTRPGTTSRQGHLGRRLKAQASSRAPSNQASLSRSCTTSPTITRVGACTSCSATSCGRFSRVPVNTRCWAVVPCWISAAGVCAERPWATSCSQITGNPTRPM

SEQ ID NO: 31695 - protein, 85 aa, Pseudomonas aeruginosa
VEGIQVSSLARISRASTGASPPLETATTSGERSTMAGKITLHRAGASTTLTGIPRALAARDTSAFSGSSSVAAMIRAQPGWSPSW

SEQ ID NO: 31696 - protein, 627 aa, Pseudomonas aeruginosa
SRSSSSPPPCSTRCRSSMWICGATTRRRAPASASRRALRRATSPPPTTSARRPCKEWNSGRKSMSADHLDASHVGLEDFRHTDRAVRLLVVLQYRHQGAADGQAGAVEGVHQLGLAGFRIAVAGLHAPGLEVAAVGAGGNLAVLVLAGNPDFQVVGLGRTEAHVAGAQRQHPIRQLEQLQDALGVGGQAFQRLVGSGRIDDLHHLHLVELMLADHAAGIAPGGTGLAAEARGMGDELQRQLLGVEDLPGDDVGQRNLGGRDQVEVSFAVAADLEQVLLELRQLAGALQRRSLDEIRGVGLLVAMLGGMQVDHELRQGAMQAGDRAAHEGEARAGKLGSGLEIQPAVPFTEGDMVLDLEIEGLRRAPATHFDVGVLVGTDRHRLVRQVGNAQQHGIQFALDGVQLALAFLQLGAHAIDIGQQRRDVLATLLGLADRLGTRVALGLQLLGTGLYRLALLFQRFDACDIQLEATGGQAGSHFLRLGAYQFGIEHALFSSRVGYRRFVARLALRRPRRRHRRRRGSLASSAEPIPLRIFCVGGDWCDPARPGVPACRGSSVPGPSAPVDSNAAAPDPRGNNPLRRHRHPARRGRSGIPRHSRGSSSIWSARCASAMALPASRFRRRRASPR

SEQ ID NO: 31697 - protein, 127 aa, Pseudomonas aeruginosa
AIARSAHRYASGTVPAASGSVGRRFPAGACRYRPGSVGKNARSGSGPCSAGRSGAGQRRCRRHGPAKRPWPGRQRTTCGSVASESSKTCRVQSRTGAGAMTSREPLVFIGVTTPAISIASIIRAARL

SEQ ID NO: 31698 - protein, 175 aa, Pseudomonas aeruginosa
IDSSSIFGSIMISRASLGVDLNRIDRSMALTPTDLPEPVVPATSRCGIFARSVMIGRPPMSWPRASGTVDLCSSYSGDDSTSEKRTICRSSLGISMPTVVLPGITSTTRTLITASERARSLARLEMRLTLTPAAGWISKRVITGPGCTESTLTSTPNSFSLISSRRDIASSDSGE

SEQ ID NO: 31699 - protein, 193 aa, Pseudomonas aeruginosa
LFCFTSAGSSSDSGGRVPSTAVSTNSGACFSFSTRLLGSGAFGGGGGSIFGGGRFSRSLMCLARASSRSSRRSLALDCSRRSGTLGATTSATRSSTSRSCATSCLRSARAPIQRLKAFWISSKKSRVILPVTSITLNQERSANTVRPKRNRAKNTSVLPCTFSASTATRPRLWPMAPPAEALAGMWPLAWKWM

SEQ ID NO: 31700 - protein, 215 aa, Pseudomonas aeruginosa
WHLYLRCIDHCHRCLRAIPGHVVGRSLHGQGRFRLRHLRRFFYRNQVVCVVGGGNTAVEEALYLANIAKEVHLIHRRDKLRSEKILQDKLFDKAENGNVRLHWNTTLDEVLGDASGVTGVRLKSTIDGSTSELSLAGVFIAIGHKPNTDLFQGQLEMRDGYLRIHGGSEGNATQTSIEGVFAAGDVADHVYRQAITSAGAGCMAALDAEKYLDDH

SEQ ID NO: 31701 - protein, 320 aa, Pseudomonas aeruginosa
AGNHPVPRSQPAHGHAAVRLAVGGRLPPQRRPSLSSALPALHRLHRRAHTGRRLQPEPPAAAHPQAQCGTAGDPQATELQRGVLRPLSALHRATPRRRRHVSAQPRPVRHLPGPRPALLLLLRVPPAWPPAGHSRDGRAAERTLGRLYLLRSRRRAAQPGTLRDPLADRRDRTPGPAGRLPGLLDQELPQDELQDPVPAHRTVRQPALGRPHLIAVWRYCRFSGTMHAAFHGPPLIERATHRYRGLYCMSKEDSFEMEGTVVDTLPNTMFRVELENGHVVTAHISGKMRKNYIRILTGDKVRVELTPYDLSKGRITYRAR

SEQ ID NO: 31702 - protein, 881 aa, Pseudomonas aeruginosa
VDTSRCGSPIAKENARHLPGVFVAALGSGGLRRRDLELEGQLVALQVDMHQAAMLGQLAEQDLLGQRPLDLVLDKPRHRSRTHLHVVALLRQPAARRIADLELDALVLQLRLQLGEELVDHALDRLGAQAAELDDGIQAVAELRGEALLDHFHRIGGVILLVEADRRARRHFRAGVGGHDQDDVAEVRLAPVVVGQGAVVHHLQQQVEDLRVSLLDLVEQQHAVRGLGDRLGEQAALVEADVARRRTDQPRHGMPLHVLGHVEAHQLHAQGLRQLPRHLGLAHAGGTGEEERADRLVRRLEPGPGQLDRRGQRLDGVVLAEHGQLEVALEVAQQLLVGGGDVFRRDPRDLRHDILDLRHLDALHALLFRLQALVGARLVDDVDGLVRHVPVVDVARRQLGRGAQRLVAVLDVVMLLEAPLEALEDAIGVFHRRLGHVDLLEAPRQGPVLLEDAAELLEGGRADAADLARGQNRLEQVGGVHYPAGCRTGADDGMDLVDEQHRVRALAQLVEQGLEALLEVAAVLGTREQGTQVEGVDHAVGQQVRHLAIDDAFGQALGDGRLADPRLAYQQRVVLAPAGKDLRHPLDFMLTPHQRVDPPLASQFVEVAGIGVQRMVGRGRLATFLILHILLPILRMFGMPGHLGDTMGDVVHHIDTRDALLLEQEHRLAFLFAEDRHQDIGPGHFALAGTLHVEHRTLQDALEAQRRLGFALVVVLRDQRRGGIDEFLQVAPQLVQVGTARTQYRCRRLIVQQGQQQVLNRHEFMAFGPRLLEGEIEGDFELSIQHGFTSLPNIRSTVFLYLAEQWMLALPCILIDLHRLGFGHVPGKQAADRLTLSMYRQHDLGGFFPVHVEEHFQHFNNKVHRRVIVVEQYHLIQRWRL

SEQ ID NO: 31703 - protein, 105 aa, Pseudomonas aeruginosa
WMILQRWSPLQRDMSMLSGKVKWFNNAKGYGFILAEGRDEDLFAHYSAIQMDGYKTLKAGQPVNFEIIQGPKGLHAINISPATATTAAPSAPAPQEEPQATPIEA

SEQ ID NO: 31704 - protein, 448 aa, Pseudomonas aeruginosa
PFLHLGNHRVAELRAGQQGRAVHQAFEVIGHGLGGDRPVGALDDQVGRLGPTHVAQHHLRGEDQRTRVDLVLAGVLRRGAVGRLEHGHRIGQVGAGRDADATDLGRQGVGEIVAVQVQGGDHVVLGGAQQDLLQHGVGDHVLDHDVLAGLRILELHPRTAVQQLGAEFIARDFVAPILEGTLGELHDVALVHQGHRTAVVVDGVLQGLAHQALGAFLGNRLDADAAVLGEADLLDAHFLGEELDDLLRFRRTGLPLDAGIDVLGVLAEDHHVHVAGLLHRAGHAFEPAYRALADVEIELLAQGHVQGADAATDRGGQRALDGNHVVAYGVQGFLGQPGVLVIHLGGLLAGVDFHPGDLALALVCFFHCSVDNLDHDRADIDADAITLDERDDRVLRYAQGHVGIHSDFVTGRRHLDLLVSHAELRVVVKTLLQPSRVAQLSARKPHLP

SEQ ID NO: 31705 - protein, 482 aa, Pseudomonas aeruginosa
RAHRIRRQGRQGRGQEATEPAGRRSARQHVHELRQAARLLREDPAGLQGNRRHVVPARQGDHDEDFPPDRLRTCGERLLQGRLRQVGPTLRRARREPEQRYLQRLRQDQVAARLPAGRDPPRHPRGVQPPPGNGDGRLRERHHQPAHSERRHRRRLDAGDDPQLRPDVGQGRQAERHQGGNAGKHLRPHLPGDDQLLQDQRRLRPDHHGQRAERRPDGAEGRGIRLPRQDLRNDRRRHHARGPGRRQRADAARRGDRRHLARLPDQGRTDPRLGQAGRHPRTPVRYPGDLLAGPGARPRPRTAQEGRAVPQGPRPDRSRHQHHGLQRGHSRQHGTPDPRQGHHLGDRQRPARLPDRPVPDHGTGHLGQDALHRSADGGRRHVRNRRRRLGTQARPATGGRELPALGLPGRVPGPGRVPGGNRDQDRQRQGQAARQGAGRSHRQAAGQQQVAVAQGRRHRQPRQPLLPGDVLGPGPGRPGRRR

SEQ ID NO: 31706 - protein, 193 aa, Pseudomonas aeruginosa
  UNSURE (41),(43),(44),(45),(63),(72): Identity of amino acid at the above locations are unknown.
RSRNPGPTLGVSFYRGLFRTEETSMSWHPHVPRSDHRRGPXPXXXGRGTGRRPRGAEPARRAXGARRKPVGXRPARNLRGNRLGGRAERRHRHLPVHRAVQRCHLSARMLRRPPRAPPPRARPRRRHHRPALAEPRRTGRPAAALAQPPGAALHRRLPGRRPLSPGADPRHPRVALPTPGLIEFAFYEFARDA

SEQ ID NO: 31707 - protein, 516 aa, Pseudomonas aeruginosa
SKRRKPGISEDARERSATATDCPRRRLRIRSPGRQAGTHRADQRSPAGLHARQPAGAQPGQHPGRLRWRQPQPARRLQGPGQRPGAQARQPAARTAALRPGDADPGTATGQARRHARPDRPAPRPGRTAGPALRPGPRERHRLVRQHLPGHPQHLPPAHPGTRRHAPPAGQQQRRADPRPAARRHPLGAALAATGRQPLADGIQPAPAAQRTLSPAARLAMAMAGSQPQRRNSPTQGAAMLALSALFFALMGGLIREASSTVNNETVVFFRNLVGVLFFLPLALTRGIGPLRTRRPLSHLLRTTYGLGGMYCYFYALAHLPLTDAMLFSYAAPVFTPLIAHLWIKEPLTRRMMVATLVGFLGVLLVARPSGAVVAPIALVGIASSLMAACAFVSIREMSDSEPAYRIVFYFALFGTLFSAVPLAWAWQPLNGQELLLLLGAGLFASLGQLTMSQAYALASPGVIGPIAYMAIVFAGVIAWLRWDELPSHTSLLGAALIFAASLIPLLGNRPAERPR

SEQ ID NO: 31708 - protein, 481 aa, Pseudomonas aeruginosa
MPHRGAPFMYDMRPFFVDFQPRERLMQLSSLTAVSPVDGRYAGKTSSLRPIFSEYGLIRFRVMVEVRWLQRLAAHAGIPEVAPFSAEANALLDSLASDFQLEHAERIKEIERTTNHDVKAVEYLLKEQAAKLPELAAVSEFIHFACTSEDINNLSHALMLREGRDSVLLPLMRQIAEAIRELAVKFADVPMLSRTHGQPASPTTLGKELANVVYRLERQIKQVAGIELLGKINGAVGNYNAHLSAYPEVDWEANARQFIEGDLGLTFNPYTTQIEPHDYIAELFDAIARFNTILIDFDRDVWGYISLGYFKQKTVAGEIGSSTMPHKVNPIDFENSEGNLGIANALFQHLASKLPISRWQRDLTDSTVLRNLGVGIAHSVIAYEASLKGIGKLELNAQRIAEDLDACWEVLAEPVQTVMRRYGVENPYEKLKELTRGKGISAEALQTFIEELAIPAEAKVELKKLTPAGYVGNAAAQAKRI

SEQ ID NO: 31709 - protein, 180 aa, Pseudomonas aeruginosa
SWSARPMRCIWKTSANGWPMTMRVSCWRSWSNRAVWSLQMNKIRVRVADWQKDNAELRRIREAVFIAEQSVPPELEWDAEDDEAVHFLAYEGEYAIGTARLLGDGHIGRVSVLKDWRGLKVGDALMRAAIEEAERRGLKRQLLTAQVYAIPFYERLGFKVDSGEFLDAGLPHVDMVRDSD

SEQ ID NO: 31710 - protein, 208 aa, Pseudomonas aeruginosa
GPMSDAPETSPADLPAIEFSSPGCFAVRNPASAALPAERWEPAPFRLGEHEPLERFEHPQEARAHALALLQQARRSLCLHSPDLESWLYHHSSIQEACTRFLLANPRNRLRILVGDSAQAVRNGHRLISLSRRLSSNCLIRRLNPDYPKEDDAFLLADDQGLLLRPKPAQPAGYACYRAAGRVRQLQARFEQAWDTSLSDPDLRSFLL

SEQ ID NO: 31711 - protein, 685 aa, Pseudomonas aeruginosa
RQCSVDQPTRSTSVSLEKKDAILFGDGDELPSNHSNNPHMNDLIAGLGRRQVLAGGAALGALAFLGVALPASAAPAEAQAPAAEGLRGLPFKRRNRLPFEAIASGRADTIRVPAGYKATPFIPWGTPISGSYPGFLDDASNSAQDQAEQIGMHHDGMHFFPIDAQFGFGGGHISNHGLLVLNHEYIDAPLLHTNGPTVVDGKRTVADEVRKEINAHGVSVVEIRRNVRGEWNVVPSQRNRRITAATPMRIAGPARGHELLRTRHSPDGTRTRGTHNNCSNGFTPWGTYLTCEENWVGYFSTQDSELPRELTRYGIRNTSRFGWETLAGDEFERFDATRKGKQAQDDYRNEPNNFGWIVEIDPFDPQSVPVKRTALGRFAHEGLVFAPVKPGRQVVCYSGDDSQNEYIYKYVSRDKFRPGRSNARLLDEGTLYVARFNADGSGQWLPLDIADGNFRAACRKAGVSFADQGEVLINTRLAADVLGATKMDRPEWGAVNPDNGDVYFTLTNNTSRTVADAANPRVKNAYGHIIRWRERSRDYAGQRFTWDLFMLAGPGEDSRGPDGKPLNQDNILASPDGLWFDPEGRLWIQTDMSGSQLSSGPFGNNQMLVADPRTGELKRFLTGPLGCEVTGIAATPDFRTLFINIQHPGEGSTADNLLSTWPDGPGRRPRSATVVITREDGRRLL

SEQ ID NO: 31712 - protein, 210 aa, Pseudomonas aeruginosa
RATTTCVGRNAGAGRRYSRGQARAKRVECRLPSLWKDASMPKRNRLSRAVGAINLLPRRLRSRSLTLLLGSQVRFAGTARVRIHELGQERAILSLKNRRPVQNHIKGIHAAAMALLAESASGFLVGMNVPDDKLPLIKTMKIDYLKRAQGDLTAIATLEAGQIEQIRQQDKGEVRVAVLVSDENGNQPIACEMVWAWVGKKPRDATAAPR

SEQ ID NO: 31713 - protein, 231 aa, Pseudomonas aeruginosa
NNEALAMQYKLTRIDPDAANDQYPIGERETVADPLVEGQVHKNIFMGKLEDVLNSTVNWGRKNSLWPYNFGLSCCYVEMTTAFTAPHDIARFGAEVIRASPRQADFMVIAGTCFIKMAPVIQRLYEQMLEPKWVISMGSCANSGGMYDIYSVVQGVDKFLPVDVYIPGCPPRPEAFLQGLMLLQESIGQERRPLSWVVGDQGVYRAEMPAQKDLKREQRIQVTNLRSPDEV

SEQ ID NO: 31714 - protein, 183 aa, Pseudomonas aeruginosa
SPTWVASISLWLTWTADMSQSNLIQTDRFVLSETERSSIEHEMHHYEDPRAASIEALKIVQKQRGWVPDGAIPAIGEVLGIPASDVEGVATFYSQIFRQPVGRHIIRVCDSMVCYIGGHESVVGEIQKQLGIGLGQTTADGRFTLLPVCCLGNCDKAPALMIDDDTHGDVRPDGVAKLLEAYV

SEQ ID NO: 31715 - protein, 724 aa, Pseudomonas aeruginosa
DEPLHRLLPLRALLQGLRRRHRPRRLRRPRQRLLRTGRGRRAGKRVLRQPHRGLPHRRVHRQDPLRALQPQVGHAVRPEHLPRLLQRLQHQPRRALRRDPPHREPLQRLGQPLLPLRPRSLRLRLRQPRRPSAPAAAGAEQAEAEPGRRPRPGRRPAEGAQGGRHRFAARQPGKQLRPARAGWRRQLLQRHQRRRARPPAPDPAGHAGRPAAGAEHPRHRGPRRGLRPRRGPDPDRRPHRPGPAPVGEGQGRRDGCRHEGPAVARRRGEEHRPACAEPAVHRQRQRDPPRRRGRGNRSRRAGRSRSPRLRRGPRDRPKRPVRGRPRPAGPGLRPAHRRCPAGGQASAGSVRQLAGQQGIDRSRGEHRQGPQAAREERFHQPGGRRSQQPRPGALRRRLRGSRARATDLRTGRRRGGAGERSLSPHRHRPCRRGPGGGQGGDRRRSPADRHHRQGAPGAAGGQLRRRRRHPGQPGRPRPALLPGVRPDLLRRQEHGPRGLALAACDPQHPARQARRLDPVGPRHRSRGRGKADPGRHPRRRTGRLVPHQGPQAGPRTAPVQRAHRHARQYQRARAAHPAGHRLGVRLLHGRLLRQPGRPSADPVRLVAGLELAAGLEQVPGRGRRPPARRRPRRAPDRTEGRRPRLVPGRAGAVQRQGRQLEGSAAVPPVRQRGKQLAGRADPAAHPGDLRRPVQGRRGPPRRQRRRDPRLPAQGPGPAPAAAYR

SEQ ID NO: 31716 - protein, 364 aa, Pseudomonas aeruginosa
TTRRRPDRPAGRLRRHPGGDRRLLRGRSAGGCTMSWLTPALVTIILTVVKAIVVLLAVVICGALLSWVERRLLGLWQDRYGPNRVGPFGAFQLGADMVKMFFKEDWTPPFADKMIFTLAPVIAMGALLVAFAIVPITPTWGVADLNIGILFFFAMAGLTVYAVLFAGWSSNNKFALLGSLRASAQTISYEVFLALSLMGIVAQVGSFNMRDIVQYQIDNVWFIIPQFFGFCTFIIAGVAVTHRHPFDQPEAEHELADGYHIEYAGMKWGMFFVGEYIGIVLVSGLLATLFFGGWHGPFLDTLRWLSFFYFAAKTGFFIMLFILIRASLPRPRYDQVMAFSWKVCLPLTLINLLVTGALVLAAAQ

SEQ ID NO: 31717 - protein, 189 aa, Pseudomonas aeruginosa
KACCHKETSRGIRFLFRCRRRRTGHAAGHHQQQPGACPALPDHFPAGHLDDLLQPRRTLRRCPGDHRLRWRHHGSVRLRGDDAQPRPGRGRAGAQVAHARHLGRAFGPGPGPAGGTAGGPRPHPERCRHRPYHGRRQGGRHQPLRPVPAGGRTGLHAVARGPGRCLSPGSSRRQTIKVRRAPCARPKGT

SEQ ID NO: 31718 - protein, 357 aa, Pseudomonas aeruginosa
RYERNTTGTRPGPRQRPVRPRTGRLDGATQHPVRTDEPGSDDERRRPRLRGRRQPLGPTRRPGDVHPGAEPRGRRSEHRPGDPAATVSPLPHPRYRRCQRDARMNLLPLTFLFPLVGFLLLSFSRGRWSENLSALVGVGSVGLSALSAAWAIFSFHSSPPEGGAYSLVLWQWMAAGDFSTNFTLYLDGLSVTMLGVVTGVGFLIHLFASWYMRGETGYSRFFAYTNLFIASMLFLVLGDNLLFLYFGWEGVGLCSYLLIGFYYSNRNNGNAALKAFIVTRVGDVFMAFGLFILFQQFGTLNIQELLVLAPQKFPEGNLWLTLATLALARRRGRQVRPAAAADLDGRRHGRPDPGFPR

SEQ ID NO: 31719 - protein, 534 aa, Pseudomonas aeruginosa
AWCSAWRSCWSCSGSTRSQCWTSPRPACTACSNGWAQPFPPLQDGSREMTFTIQHFIALLPLLITSATLVVVMLAVAWKRNHSFTATLSVIGLNLALLSLLPVLGVTPIEVTPLVLVDNYACFYMALVLVSALACVTLAHAYMESYPGNREELYLLLLLATAGGLVLVSAQHLASLFIGLELLSVPVYGMVAYAFFNKRSLEAGIKYTVLSAAGSAFLLFGMALLYAESGTLGFAGLGAKVAEHVLSGPLVSVGVGMMLVGLGFKLSLVPFHLWTPDVYEGAPAPVSAFLATASKVAVFAVLLRLFQIAPAALDNQLLNISLSVIAVASILFGNLLALTQSNIKRLLGYSSIAHLGYLLVALIASKGMAVEAVGVYLATYVLTSLGAFGVITLMSTPYSGRDADALFEYRGLFWRRPVLTAVMTVMMLSLAGIPLTAGFIGKFYVIAVGVESHLWWLIGALVLGSAIGLYYYLRVMVTLFLVEPGIRQHDAPFNWGQRAGGIMLVAIALLAFFLGVYPQPLLEILQHSGLALAG

SEQ ID NO: 31720 - protein, 307 aa, Pseudomonas aeruginosa
VARSTKTPPRRGFSLARPTHPAPLPWHAPRSMDEPGGLMPTFHEIDVLRHNSASWDAQAARDCEWSRPVSAEEVAAARRGDWAVKLTPGALPAHWLGDVRGREILCLASAGGQQAPILAAAGARVTLFDASGGQLDKDRQVAARDRLELACVQGDMRDLSTFADASFDLVFNPISNLYVDDVLPVWRECARVLRPGGKLLASFYNPALFIKDRSPELAEQGLIRPRHRLPYSDLESLSAEALAAKREKGEALVFGHSLTQQIAGQLAAGLLLQDFYEDWQPHPRFVIDRFMPTFLATCALKPRSAAG

SEQ ID NO: 31721 - protein, 138 aa, Pseudomonas aeruginosa
AERRQPPFSTGRLRIVCRAALSCPNIPGLKKPSCAAASSSTASRTSSPSPVVTTVLRPRSCCPPASRWRKRPCASCSTSPRSRHPATPGTSARPAPRRTSIPAASPRSAPSSPVRRTSSFPLPSAPTSIAACACCVPA

SEQ ID NO: 31722 - protein, 213 aa, Pseudomonas aeruginosa
STAARAMSASTSASAGWTVPAPPGRAAGATPRPASTRWAASWPENTSRPWVAPARYAWLNRVVLAELVRKVLRETFQRDDSALLVDVPHNVVLQEQGLNLHRKGATPARQGDLLLIPGSMGDYSYIASGLGHPDWLWSCSHGAGRSIRRQALRALKGPGDSALPWHCVTLREERRIEEAPGAYKPVGPVIDAQERAGLIRPLARLRPWLTFKA

SEQ ID NO: 31723 - protein, 466 aa, Pseudomonas aeruginosa
APGRRAAPAPWPAGGLWISGSDASSTPSMTPNKKRDSRFIGNPVGSLSGRPDIPSGDRPRWNSEQHRGGPAEHQQRQVVVQEGRHHGVPDVIVLAVDVEPGGRPKGRVRRRRTCIPQRAGGADDADDGQRAEAQLHRQRDEDRGDDRHGGERRADAHGDQQADQQHQHGADRLAVADPGHRGVDQALHLAGGLHHLGETGRGDHDETDGGHHLHAFGEQVVGLLPAHHAGQREDHETDQRADDHRVQPQLCDERGDDGYPGHRQALRVVADIDAFGLLDPLQVVDALAAVAEQHRDEQPGEHAQGWDEHGVGDVDPADVDAVARHVGQQDFIEEDVAEAHRQEHVRGDQAEGDDAGDQSPVDLQLAQHIEQRRHQQRDEGDMDRQDILRGYRHAEQQADQDPLERTGALALLVVPAEQRQDLVGQRMGHAGAGDGHGEGAEHGVRQGHRGTPAEAAVEGLESPLKA

SEQ ID NO: 31724 - protein, 760 aa, Pseudomonas aeruginosa
TVVHGSCVRFAERRQSGASDRTVVKNGRALPISLGPPQFLRTRTPPMFLRRLSIQWKITLLAGLCLLGVVALLVGLSVYRMQHSSVLVKSASTQMLDESARLRLEARGELQALRIQRYFMDAFQYGKGFSRQILFLRDQAQKRFLDAYDLREDLTRQVRTALAANPEVLGQYVVFEPNALDGKDELLLDQPALGSNDKGRFSLYWAQATPGQLESESMIESELADTSSGPSGAAYNAWYTCPKESGQPCVLDPYFDKVGERQLLMTSIAFPLELDGKVIGVMGLDINLSNLQALSEQGNRELYDGVGQVGILSPAGLFAGNSRDAGLLGKNLAKADPQHAGELLQLLAAGKSRLFNENDDLKVLQPLQPIPGAKPWGVLLEVPKSALLGPALALERQLDDMRREGTWVELGLGLGAAVLGLLVLWLSARGVTRPILGVAHMLRDIASGEGDLTQRLPHTGRDELGELAGWFNRFLDKLQPIIRDVKVSVRDARSTADQSAAISSQTSAGMQQQFREIDQVATASHEMTATAQDVARSAAQAADAARGADQATRDGLALIDRTTQSIDSLAANLTSAMGQVEQLASSSEEIGSVLEVIRAIAEQTNLLALNAAIEAARAGDAGRGFAVVADEVRNLARRTQDSVEQIRGVIEGLQQGTRDVVDAMHGSHRQAQGSVEQVDEAVAALQRIGEAVTVINDMNLQIASAAEEQSSVAEEINRNVAAIRDVTESLSSQAEESAQVSQSLNRLANHQQGLMEQFKA

SEQ ID NO: 31725 - protein, 147 aa, Pseudomonas aeruginosa
PARRAGYPARAPPGAGRGGYRGRHRRPSGGPCPRPARRSGGLRYRPTCRRCPADCRASPAGPRGPMAGAAPVARSSSPAGAGRGSGAGCRTATATPRRNRNVRQAALRRPGGPCPTRDRGAAGSVPAVRAGPVATPAGAPSPRARRG

SEQ ID NO: 31726 - protein, 133 aa, Pseudomonas aeruginosa
SAPPAAPVPREPGCPVGYAGPAAAGRSAGAPPPADAANDARSGAATAIPGAAPGRRRPDPSTAHGRSFPGSAYSPAPPRSAASGPCACSGRGTPAVAAPRAHRPGPAPALSCAALPARCPTGSVSARCPFPAR

SEQ ID NO: 31727 - protein, 228 aa, Pseudomonas aeruginosa
VVDVDLDDVGIAFGLAVVQMLGQVPLGQDLAGVQHEIAQQAEFGGGQVDVGAVQAHALALLVQAQPGGLQLALVGQPMGAAQQGLDAQGQLFRMERLGQVVVGTGLEPIDAFGPGTARGEDQHRSRESQPTPLLEYLQAGTPGQAEVEDDQIVGLAGALHRRVAAVGQPVHRVALAGQAGHQFVGQGNVILNQQQPHQSSSSSFRMRPLRASSSSSRTTPSRVSSSTS

SEQ ID NO: 31728 - protein, 150 aa, Pseudomonas aeruginosa
SQPPTATWPRKCVPGASAPISTIASASIPCACRRCASAAAISSCWPATSSRKTDRAWDCAACAWTTRPRPRSSTIAGRATCANSSTWSAAPRSRPSATIRSGRGSSPCIGRISTCPRKPPRHLAAWSSPRPPRQRPVTRCARPPTPTNAA

SEQ ID NO: 31729 - protein, 188 aa, Pseudomonas aeruginosa
SRTAWPATREAGPRLHASWAWIAPTWRAWRAACNSGKRPPGRSRPGPARKPATMAPPFRLSDNPDPERTTVELFKEFTFESAHRLPHVPEGHKCGRLHGHSFRVAIHIEGEVDPHTGWIRDFAEIKAIFKPIYEQLDHNYLNDIPGLENPTSENLCRWIWQQLKPLLPELSKVRVHETCTSGCEYRGD

SEQ ID NO: 31730 - protein, 457 aa, Pseudomonas aeruginosa
MKFMGLAAGHAMHLVKTGHTQPGLDQAIFTQIALSLAGGKPMHLFEGSSLHDQVAHLGRQIDEFVDAHTAAVAGTFAAAAASRHAPLRCLPREQPRGGRLGRCQIGRSKGWLARFRAVGAQPAHQSLGLDTAHRRSHQEGFHAHVDQTREGAHRIVGMQGRKHQVTGERGLYGDLRRLQVAYLPDHDHIGILPQDRAQGGSEGQADVGMDLDLGDIGHLVFHGIFHADELAHAIIDFLQRAIERGGLARSGGAGHQDDAVGFRYPCTHPPQVVREHPEPVQAQPLALLRQQAHDHRFAMHPWQGGDPHVELRTADPDAHASILRQPSLRDVDGGDQLDPRDDRRESLAGKAQLVVQDAVDAEADTEVELPGFDVNIRRTLFHGLAHHVVDEFDYRRLLRQLPQVADVFAAVGVPIRTLPGQVQGVLQPAVQILGAAQHCLNRALRIEIAQGFAYRRR

SEQ ID NO: 31731 - protein, 561 aa, Pseudomonas aeruginosa
ANPVDTETRLSVTLEHRLTTACGAAINCKEPTWSSPDASLDCRNDERSQGDRHAQSHHPQRKRRPRGPAPGASPGAATGPRRGLAGAGRHRRQSAGPRPALGSGTDSAAVRPRPGRRRSGRRAGSGSLRTGAGRPRRLCHRPAGRLCQRPALPRRALAEAARHTRFRGRGGAAVQGHHRALPAVRHLPRRARHTHPAVRRGGRRRPVDGGLGPAPGRLGDRRGVEGGKRRAGQGCRLRRGAGVRRGQSRRPGRRADRRAQGRCGLRPHRSRYLRGIPEQLASARPAGVLRRYLRRAASRRSRHPQRQGFAIPHPSLARRPHRQPGGIPATRAGCAARPCRRCHSAPGLAALPAGRGGRGAYRSAGGTLARRAGTLALTHPQEAHACNRSTAGRPMKSPRSWPWPSTVRSPPPAAPCNAIPRCSRSGSAHWSVASASAWSNAPPGNCASPMKASAWRAASARPSTCSTRPSTKPAWAPRNCADACASPCRRRWAGSGSVRCWRSSPWRIRRWCWKPTIRSASSTSSRKASTSRSGSANWPTAAWWPGGCAPIGASSAPLPTT

SEQ ID NO: 31732 - protein, 437 aa, Pseudomonas aeruginosa
AGSLRFPVFPLQQQPDEESRHGTVRQHRRVRRQRPVRRVSRAPRQRQGAGRGDRSGNLRRQREHARGGRPVRRRGLRGPGPRPVLAAAAGRRPGLRRSGLRQGHRAVPAHRSGRRGGRHRRLYRAPAPTRGGGPRRDRLRRLLHGRQAGLPRRDAHRRLLLGGLLRHGHRGAARRGETDQGPAGAAFRRTGRLLPAAGPRRDPALPAQPAQDRVVPLPRRRSRLRPRRRHALRQTGLPDGSRTQHRRPEAGDRAELRPLRAVGRACAPRVRYPRRRRDHGDHGRRALRQPCPDPHRRRRPARTEPLLPPSLHPRQPAGHDPHADFADGGGAAGGRRVRHALHPQLRDRLAAARRPTHRALRGNPHARRGALSRRPPLPRAHLLGPGRRAGADRPARPAGPAGRGGGKRAQAARRKPAVEPPDGALGSQRRTRPLAAG

SEQ ID NO: 31733 - protein, 273 aa, Pseudomonas aeruginosa
SGRWDRTPSWARSAHRHRGWGHRPGRAGPGWHSTRLPAGINGSGCSKGRFLHRGTAPGSGSAAHPAVVPALPPASRPERPANAVGHVRRSAAGGYRGDRCGKKRSAPRPAPARIAPAAAGLRRRTPGAVAAAPGDRARRPAPGAATGRNRPVRERWCAVPAQRLRRIGDRRPSRSAPAARHRRAAPPWRSVATARRSGSAPPAACRRRNRASDGPGAARRRRPGAGARRRRRYARPGCPAHRSDSGCRRSSPRGCRPSAPGLRRPGSRAPRSD

SEQ ID NO: 31734 - protein, 419 aa, Pseudomonas aeruginosa
TTRHPARRGGRRDAPHGAGHRARRPARPHRPARRADDPGHRSARRPAARRRSGWSGARLARRGCARRCRPNRRHVPGFPGAGYRPRRTCSAPRNPPRRRWPGGRRPTSGNARPGPVRARWREPGCSPGGHRGRRHRWSRDRRHPRGRSVRQRRCSDSVGDDRRSRSLPPDGPAGRSGTAPGRRSRWSGRPACRLRRAGRTIRRRRRRKPAPADRRAPRKTAWRAPRHRRYGSAAQGRRIHSSGRCRRPIPGRSVAPAGRSGAGSVVPAGRCWRPNVLRCRSRNARPGRNNRSTRPTGRSGSTPGAARRRAGRRFASAGRAGAGLRRRSGCCRPGRAPSSHCPVRRARRSSGAASRPPARPAARSLRRRACDSAPCPATPPRASAPGHRAGAASPVPADRAWRPGGRTGRSRTRYGCRRP

SEQ ID NO: 31735 - protein, 138 aa, Pseudomonas aeruginosa
AGHVRSSGTRCGSRRGRSWPAGARYRRGNAGNAGSCGRTAPARSPPASAVRPAPPPSARARPALRRRSNRRGAATAPRCRNNAGHREPAQESRSGGPGRRPARRRLRSVPGACSRPAATSPGRAGRYGGCSTGSHGRR

SEQ ID NO: 31736 - protein, 320 aa, Pseudomonas aeruginosa
SPAAGGPNNAPAARQMIVQPSAVAKGWPIATTLLPASCGPADPKPEPKPKQRRLCRKVFPLRARCGALAHCPIPGKNEIFTNVNHSHISIPSPRLLLVEDDPRLREDLDAHFRRRGFRVTVCGDGSHGLEAAGREAFDLVLLDIMLPGLDGLALLESLRREQATPVMLMSALGAEQDRISGFTRGADDYLPKPFSLAELDARTDALLRRVRLDRLPSAQRRDTRLVFDDQAQDVLHQGLPAGLTPSEYRLLATLREHAGEALSKPFLYRSVLHRSYTRLDRGLDVHVCNLRRKLAAVAVRHLQIQAVRGQGYLLVETEHP

SEQ ID NO: 31737 - protein, 230 aa, Pseudomonas aeruginosa
VSPSSACCCAPCPTNCARRWRACASPTTASYRRNSCASAWIAKSATCNDCWKTPSTSPGWTPSARNCPPSRCWRCRCGKRCAMTPVSKAAGTRRGYPAAWASTVASRYTWTAWPRPWKTSCATPSVTRPRTARSASTASARATSGTCACRTRALAWRKTSWNASSSPTSAWTIAPAKVSASAWRSPGAPSSYRAAGSGPATASPDCACTCGCRRPPEGEVFRKLMRFTLK

SEQ ID NO: 31738 - protein, 200 aa, Pseudomonas aeruginosa
QSISFVISCISLHCPEIPDVLTRPSRRSLPAAVQLPARQRRTRRRPGRRLRHRAGRADRGRHRPGGNQAGAGGFHHHRRGHRQATAEQRPVADHPDHAGGQPDRQQLQRPAWQQPADRHPRHGPGEHPDPGRRQAGQLAQLGALRLARRARQPRRHQLGAGRPGRAHRSDPRPGGGALRQRRGGRRGEHHHQAGRRGNPR

SEQ ID NO: 31739 - protein, 308 aa, Pseudomonas aeruginosa
RESLMRTSLLVAALGLALAAALPGGAPLAQPDPEATMDRSLLQRQDLPYRFSAVDLDSVDGQRHYRLWLGRPLQAPPAAGYPVVWMLDGNAAVGALDESTLRRLADGDAPLLVAIGYRTPLRIDRAGRTFDYTPASPGQADQRDPLNGLPSGGADAFLDLLRDGMRPAVAAQAPLDTARQTLWGHSYGGLLVLHALFTRPGEFARYAAASPSLWWRDGAILGERAGLEQRLRGKRAELLLWRGSAEPASPRGSLKAEPGQAMARLVDDLRRVAGLTLDFQPLDGLGHGETLGASLRLLLARPAVERQR

SEQ ID NO: 31740 - protein, 184 aa, Pseudomonas aeruginosa
TSSRPSTLRLRSTCRRPWASRSPGICPVRVLARTPTVQTTVFASIRWPSSSVTPSASTAATERPRHHSTPSSAEASAIKPLRSAPIDAPMAAPRSTTITRSAAFSPRIARRRAGISVAVSMPVKPPPATTTVLRAGESGKSRRACRCASRRRASSNWSTSKAASMPTTLAGRHTPLPAASTRRS

SEQ ID NO: 31741 - protein, 188 aa, Pseudomonas aeruginosa
KPRRILRIFLSELVMALYSAGVEYGIHCLLFLADEKGDSRESSVRTLAELQGVPPELLAKVFTRLAKAGLVAATEGVRGGFRLARPANEISVLDVVRAIDGDKSIFECREVRERCAIFEGNPPSWATRNTCSIHAVMLTAQKRMEEALAQQTILDLVRRVGRIAPPEFGEEVLRWMDASREGRGGSRD

SEQ ID NO: 31742 - protein, 282 aa, Pseudomonas aeruginosa
PARRAGCRATPPAPPAAEPANAPAAGCRRSPPTVRRPATIRRASSSFSFAAVPPGGPERHGRHSLGRIRADAFAVGHPLGRLVHHGVGVVHAHAVGPGMLLGDGHHGVVGIPAGPVALPLQQDLLPGHRYHAGLDHAVHGVLVGVAGGAARGIGHHVDLVAALEHGAEGEGGVADLGPQPGDHDLLAARGGQRVAHVLVVPGVHRGAFEDLLLGEHRQQLRIGRAGEAVGFHRGDGDRDVEYLRRLGQAHYVVLQRLAIDGLYAECHLWLLVDEDDLAVLRS

SEQ ID NO: 31743 - protein, 442 aa, Pseudomonas aeruginosa
KKDYQLAESTVRPIRKSPHEVQDMSRALLAIEHQQVALAGGCVIRENRSFVPYVSRRTYPVRWPLSPPPSLTDSAPLPGARHEPRSAEQGPPPFPHYQFGAGRRRSPVVRPALRQRRQPFSRKQPRRFHDRRPDPAQRPFPHRGPRQPHRHRRGDQGRQVPCRRQRRRCDAPSRQRHPGDRPAEAHRDPRSQRLAPAPDPRWPQLQPGAALGRRALPGRRLAHAQEPGRTHAQPPVGAGGRRLERVPVRREAHADPGGIEQGRAGHPGVRPPPVRSRPAQPRRPARGRLHQGHAQPARRRDRPRQQRRTHRHADRPAQRDDSLRHPGQGTEAAAGIPGQLHPPVHARTQPPRPDQRDRRRRRLPELPGRLPGDSRTGRPGPAHRTHRLQPVHPETEGRTRRLQELDRQRQVRPGQRFLPPQRRRRDAGVLRRRLRGLPRTAP

SEQ ID NO: 31744 - protein, 396 aa, Pseudomonas aeruginosa
IDLADARRVREGRPRHSVQRPALVLRPRRDHHPVQHRAGAGTRRRHRDPGPHGLPGRVLRRPLRCQGRRGHAADPAHARRGRAGGCRHRRHPGLQLQPLDLAVLAGQRSHRRRHGPVSAGPAAGNRVAAVHPRQRLVLQRAGQERTDQGWPARRPGGAVGGLLRRRGRGHQVDRVGAHGGRRQGRLCRRRVRQARSAGAAGAAGLVAGGQGTRPLAARRAADRPGPPVRRCLRGTRPRAQPRAPLQRTGERLPGFLGRIRLFLLRFLTYPGGPFAARLARSFPDDPRSTGRPPGPFPGAGRHLAVPRRDTGSQGARLPGVAPAQPQLLPLQRLSPRGRRARLPQGMGTRPDRRPGVGLYSRPRRFRPRSPRLRRLQARRRTWPCRHRPVAAGLIRR

SEQ ID NO: 31745 - protein, 664 aa, Pseudomonas aeruginosa
LHLPRQLDQVRRFQRSGRTLLAGPLRSRPGPVRPAGAELHGALRQRPRHRRQPCAGRRRLQPAGRRWPLPALAGQRRQALGARPRPALPVRLGPVQGPLAERLAPQPPGQRGPGRRRHRPPLPDRRIPTQRLALTMTAPAASPWSPLRQATFRWLWLASITSNIGTWMHEVGAGWLMTSLSASPLNVALVQVAGSLPMFFLALPAGALADIVDKRRYLLGVQLWMALVATLLASLTLLQLTSVWLLLGLTLCMGIGTALMMPAWSATTPELVGKDELPAAVALSSVGVNLARAVGPAIAGVLVSLVGPWLTFALNALSFFAVIAVLLAWKREAVPSVLPAERLFGALRAGWRYSRSSRPLQSVLVRAVAFFLGASAGMSLLPLIVRGELHGNAMDFGLLLGSVGVGAVLGAAFLPRLRERLGSDRLMLLSSVLYALVLLALALLRNLYLLVPVMLLSGAAWIAVLSSLQVAAQTSVPAWVRARALAVYILVFFGSMAAGGALWGLVASHLSITFALLCASAALLLGLFASLRCRLPVTEAEDLAPSLHWPAPLVDEEVDQERGPVMVTLEYDIDPQDAAAFQAAMVEVRAMRRRNGAVSWGLVQDSGNRRLWLEFFIDESWLEHLRHHQRVTRGELRVEAAARRFQSAGVEVRIRHYLHGAARP

SEQ ID NO: 31746 - protein, 144 aa, Pseudomonas aeruginosa
ASRATVVACPWRIRPRLLSCSPMAPQGRWPVAMPRTRGAANATHREVHACPTTTRKPASPSTGRYSRPTTTATSVATCVPTRNSPRLRKSPRCCIRPSTAPTPLASPPARRTSSPAATASTPRIPAAPRCSTAPACCAAPTATS

SEQ ID NO: 31747 - protein, 78 aa, Pseudomonas aeruginosa
TMNLKPQTLMVAIQCVAARTRELDAQLQNDDPQNAAELEQLLVGYDLAADDLKNAYEQALGQYSGLPPYDRLIEEPAS

SEQ ID NO: 31748 - protein, 159 aa, Pseudomonas aeruginosa
SRVPRRSGRSACRRSATTPWRGRSATRRAIAGSWCAAAEGAGAGCATNSSGAWPVPPGRAGPASARRGSPGPCPARHDARPGRCSAAGTVPASPGGSPGRPAATGAPAIRRRSRWRCARVRSATRRRNPRRRPAPSPRRRHSRRPLPARAAAGRAGRRG

SEQ ID NO: 31749 - protein, 587 aa, Pseudomonas aeruginosa
ASCVPPRLSPVPQAVGSTAREEAHALLQAAQGQRIHLFLDQFADQAGGRRVVPGVLRIGVDPDELLVLLHEALHPDVTGFLVPVLDAAAGLGDFVGRHRRVADEHHLVVRTVLVQQVEGGGAFAAAAQVVLPHRLVDEVVEVEILQVLELGLAGREQLLADLDVGVHRAADVQQQQQLHRVAPLRAHLDVEQPGVLRGVVDGAVDVQLLRRALAGELAQAPQGDLDVARTQFDLVVEVLVFALVPDLGRLALALAGVADADALRVETAGAERTGTAGTDPLVTAGMALLLFLEAFLELLDQLVQAAEGLDLRLFLVGQQALELLAQPFLGDQRLEVVVELLQALEVGAEGPVELVEVALVLDHDGARQVVELVHVGEHHAVLQGIDQVEQLAHRHRHLGCAHFVEQVEQHGCDLVCCPLIPARERRSVLVFLRQVVGDDVPVGFRTHVDVPLRYRWQRRVEGAEGNRGVRRVLVAAKPLQVRSAVAAEGTGDAWRRVVFGHRVRSGDIAERLAAHLAVGGERRAVGLAALAAMTMTGRLDGRVDFIAYRAAQATSAEHGMFLRCLACRPAALSSERADALSGWRGGS

SEQ ID NO: 31750 - protein, 164 aa, Pseudomonas aeruginosa
SFSMRQGHHHEPHLRRQRAVHRQHAAGPDQPHRPARRHHPGQDRRAQPRLFGEVPDRREHDLGCRSQRQTEVRHDPGRADLRQHRHRPRLRRRRTRLQTDPDHAGVDEPGATQGAQGAGRGAGPDRTGEGHEGCDPEGRGTGRGGSREVLHAAAVRQPGQPGDP

SEQ ID NO: 31751 - protein, 317 aa, Pseudomonas aeruginosa
ARQGPAHRPGDAGDLSDLLYLLAEAAGHSRHDGDHPRRATDPHRRHPRTPAVAGAPVRPAAGPGRPGAGGLPGHRPGRDVHGRHPLRTAGAGRRHRRLDHAEGHPREPAGHPAPAVPRRPRPVPGVRALPAVRVRMERRLPGPRAMDGRRGLGGRDPAALPADRPGQPGQRHQPVLPGAGGDRDHGLHGLRQPPRLAQPAGHGADRGGADVRLPQGRLSEPSGSRPALGRARADSVLRELASHRREPRPRHRRHIARPHRLAALRADHGRPELVATGLVHILHRSRRGPRRASGRPNWPGPAAPDARSWPMSVRRYS

SEQ ID NO: 31752 - protein, 818 aa, Pseudomonas aeruginosa
EGKADTTGFRVPPARRPCSTASGSPERTKPARLGCAPGCAGNDNNEEHTVTTPSPQWKKTACILCSLNCGLEVQTENGRISKIRGDDDHPASQGYVCEKSQRMDYYQNGADRLDTPMRRRPDGSYEAIDWDTAIREVAEKFLAIKRRHGGESILYYGGGAQGNHLGGAYGDSTLKALGVKYRSNALAQEKTGEFWVQGKMFGTGVHGDFEHCEVAILIGKNPWQSHGFARARVLLNAMAKDPARSIIVIDPRLSETAALADFHLQIRPGTDAWCLAALVGIIVQDGLLARDWLAEHTSGYEHIVDELNAIPVAYCAETCGVAEDKLRAAARRIASASSVSALEDLGMQMNLHSTLGSYLQRLVWLLTGHYGRPGTSNAFVPFLSLSKASKGDTSMGKRGAPRVEKRSPVANAKIIIGLIPCNVIPEEILTDHPKRYRAMLVETGNPLHSLADSQRMREAMRALELSVVIDVAMTETARHADYVLPAASQFEKAEATFFNLEFPRNAFHLRAPLFPARPGTLPEAEIHARLLEAMGVLGEKDYRPLRLALKLGRKAFSAAFLAAAATRPKVMKYAPVLLYRTLGPTLPAGMEAAAAIWGICQLHVLNNRKTAARAGFDGLPPLAADRLFQAMLDNPSGVVFAETTYAESWQAVARPEQRINLHIPELLPELAKLAHSAPPHDPAYPFILAAGERRSDTSNTAVRDTGWHRRGRYGTLRISPQDAEALGCADGEVLRVVTRRGEVEAEVEISDMMQPGNISLPNGQGLDYRNAEGEVVRRGVAPNEVTDCTQRDFLAGTPWHKYVPARLERLATPAATNA

SEQ ID NO: 31753 - protein, 418 aa, Pseudomonas aeruginosa
RCSGFGARTHEPPVTAGLQERAGLLREQRAQRRHPWVGRPAPAQLAQLELHRGHVRQRCQGFVLPGYRPQLRRRVLAGAPVARQVRLDRQRRADANHVHPAGQHLLGHRPPADAARDHYRHPRRRADVAGELDEVGLAGQGPPVARFALHGRRLVAAARQLDQVDAQAIEHPYHLAGIVGAEAAALEIGGIQLHRHREARGNLGAHRPDDLQQQARAILQGAAPGVAAAVAQRREELAEQVTVGGMDLHPAEAGPLGQAGAAGEPLDHLGDHRLVHRLRRSEVPGHPAQFQRHRRGCPGLLAEIGLHLPTGMVDLQPELRAGGTPDARPAAEFLQLRVVFQDHPAGAGHGTAVDHHVTADQQPGAAVGPGLVEAHQAFGGGLRGIGHVLLHGGLGEAIGNGRAVGKRQRVEQVHGPTS

SEQ ID NO: 31754 - protein, 337 aa, Pseudomonas aeruginosa
GQWPDDKIEVDFKVNAFFAAPPGPRPGAGSAPRHPARSAADEGQQVGVDHLGLGGRHAVREPRIDLQRAVAQQLRREYAGILVGHDLVVVAMHHQHRDVDALQVIAEVGLGKGHDPIVVGLGAAHHALPPPVADDPFRGLRPGTVVAIERAGGNVLVELRAIGRELRLEIVEDALRQAARIALGLHHQRRYRADDRRLRHRVVGIAGDVVDDLAAAGGMADMDRPAHPEALNHRRHVVGVVVHVMAVPDLAGATVATAIVGHYAKALGEEEQHLRIPVVGTQWPAMMEVDHLGVARPPVLVEEFDAILRCHVTHVASPDRCGCRQRRHPAAAVPCVK

SEQ ID NO: 31755 - protein, 233 aa, Pseudomonas aeruginosa
GSCARCSNPANPASRERPGSACRPPTAGCRTALPPCAGCRRHRRNAGTSAGARPAARCGSPARCSGTARPAAAAPCLRRRAGRGCRYAPRNAARRSPRSPPSPGPPRPGPRARKAARGKSWRRSYATRPASRPRRCRCRRRLPATGARPPAARRHPAVRSSPPHTRWRGSPVAARLAPPIRRARRSRSGGIRTEQPDAARRRPLPWVVLAWSRARRRGAARKARRGRAKRGIG

SEQ ID NO: 31756 - protein, 384 aa, Pseudomonas aeruginosa
KARPATMPGVSSVRSAAPRYSHAAPTRSRSASAPSTLPTGSSPPTNSGPSAARAGCRRFRWHGTMKGIAKATDAAKSDVVPAGEGRQHGRTVRRAPGDRQGALRAALAVLVRCLSAPGRPGFQRLPECPRPGLHLPGARRLRSGLYSSRLRPRRRARDRQGQGSIEGSGAGRRRAARTALSAGRQYLGSVCWQFLPPHCPPTEGYMTRPYLLRLAAGLALLLPAACTSPAPPAPNLTALFADALHCRGDFPDGRDRATAERLRAEGVEVLDRAPGETLDLLYRFATPLRIDGSLVNAVRVRGDSSVLVMAYAEGDLEDFARRQGATPHPAERAALDGFGELEVLYSRPLPPRPDLDESPPRLVIGRGIEAAAQAFRWGCRSYDG

SEQ ID NO: 31757 - protein, 124 aa, Pseudomonas aeruginosa
ATTDARDCTVRKATLVARPPALPAPQESIRPLREHPRPASLRSGAGYGHRAELQPDPLRRPAGRRLRPGAGLGSAGRVPRARPAGQRGGGHSAGASRPRPDPGGRRRAGRHRPTRRDPATPGQP

SEQ ID NO: 31758 - protein, 491 aa, Pseudomonas aeruginosa
RRADRPDRRLRLAPGGAQRRPERRRAPVVHPGPGALPPGPQPSRRGTAQTVLQQRAVGGGKGRRPARLAAGGQPAPAPYPGVEARPAGAPGPGPGAAPRARRRGRRRGGPATGRRNLRREHRRPAAPRSQRHRPVGARGRPGHGTHRRRRAPLQGRRHRRPLAEDRPPAHPPGRRDRPPPGQGPAARGDPHAGHRQARDDRGRRQPQGQPPARRGLPRRAHRGRQDRAGEDRHQPAVRRRERLHPLRHVRVQRRACRPAPDRRAARLRRLRRRRRTDQRDPRKTLQRGALRRDRESPPPDPRQVPADPRRRRAHLRARRSRVLLRGADRVHLEPGHLPPGGKRRTGRQRAPRRALRGGAGQGPRRDRALLQAGSQPPGNPQPDRREHHRLRLHPRRRRRADLHPDGRRHLRRPPRAAPRHRTGRGAAPGAARPLPGRPVQRRPRHPQPARSAPAQPVVAGTVRPGRAAGRALPDQRPGRRRPDPGTPLRWN

SEQ ID NO: 31759 - protein, 809 aa, Pseudomonas aeruginosa
CSTMTAACGWPASRAATTCCGYRTCCANRATNLASAPIGRAEWIDTDDTFLPQLPERTLAFGNLLRRLDPGPALRLGPFRRSHPSRRLATTAGADPGSHRAARQRAASGVRPALRQRPPAATRRPDVPGVRRRAGRRPAADAGRGHAAARRHGNPDRRLASAAADRQQRRRARALPGRTRGRRPPGGAHPVSPGRRAGPGDLRRDPPPAARTRTGNPRHRPLGRARLRSGRGAHRRQPRRPRHRAGGPRGGAPRGPRAGPRPARVQRSRPAPPRPAPGQPAGAQPRATGPGDQRLRLGAPVGVRPGYRLAAGDQPLHGPRGDRRRRGGGFRLVEPGHDPAGAVDPRLLLRRSQRQRLPDPRAGQRRGAARRPRPAVAPAAARPACTRPPPALAVAAGTGLAERRGGGRAGLGGQRKGRRRRRQHRPRRTALPQADGLRPGRGPGRALGGGPRPPAARGDRHLGRAHRPVAQAARRPAPGGPARGAGGRLPADAGAQAAEPGNPADPARRDRHPRLAAGASAGGLPADQRLGARPARTVAHRKLAVAAQDPRRERPPARPAPAHRTRRRTVAHLPAVDLAGAPRRAVAGAPAPPAGHRAPRPAGPGRAPGDRRGRPDRPAQRQHRPVPCRRGDRRGSRRPGPRRRCAPVRRGDRARPVAALAAGAVPPRRRTHQRLRPQRRAQGRRMGRAVPPGAAHAVGEGPGAAGDPAGTVAGTAEAAVRVADPRFLREESGRRGDARAAGAHEHRQEHPTHRPQRTAQRATPRRRPARPSAATQRPRGEPRPGQLPRQPATGSAAQRAVPAKLAVQA

SEQ ID NO: 31760 - protein, 1706 aa, Pseudomonas aeruginosa
GAGRIATEFHRGHALPGPTGLRRGAVPRHLHGPGDRRGPAPAEEPAALRHRTGDRAAPARERRAGSPREPAGVAALLHRGQRPVPGGRRAAGPAEPGAAGGGPARHRQEPDHRQHGRRRHRPPAQPADRLPEARRPGSGAQAPGGRGPGPAHRHAQRRQPRPRTGDPQHPRAARSAVRRSRRRPGLGAPARAPGGAYRGAGRRTGPLPPEPAPRGRGHRAELPAPARRTDRAGERLAAAGLPGPAPAPGGAGHRQPGAPGGKLRAAGPPLATGPLRRQPAGATARLRHRPGHPARLRRQPARLRRSGERPAESPRRTPGELRGRRPDALPRLAGKPGRYPAEFARGAAPAPGPLAAAVPRRHARAAEPWRRPAGGGRADRTATAPARPRTACAAAVAGPRHARREQPRTLPGPRPPGARGTHLAGSAQPAAPAAARPPAALPARARRGRRRQPPGRPPRRLRPGAPVAAAAPATGGAATEPGAGDSRHRCRSGTDRPGRPRQPAAARDPGPGSWPGPSAARRAARRGDPHRRETALRSAARRPRRRADPPGRTPAQPGQTEGARRLARRRTAGTAAPRHRRQPEQPAGPRPPARGATATSRLPALPWPRRPARSHRPGIPGPAAPAPGTTRRDSRRRTRSHGAPHAQPRSAAGLEAAPGTRQSGTAVQPGRSQGQGRQPRRSRCADARAEPRTARQGHRRRAPGQPQAMGRRHPPDRQALAAPARVHRAGRRTRPDEPAPGLADEPRPGQPRAAAQGRAVRHGDLRRSLADAGGVRPADPLSRAGHGGQRRREADAADRVLLQPRGKRRGRTVRRRSARRGRRRGAARSLRGHLEPPRDQGLPGPPATGAQRPAQHHPADPLPLGLPRADRLLQRLVLRQPPERAGTPSAGQHPAHQAAGTDPGERPVPEPEQRARGRASRRLPRRTLAPTLRGAAVGGRGHLQPQAGRPHRGAPGTARRAGRDVPRRLQRGARAQRRRRGHGRVREERGERAGRRDRLLLHLRPQRPGQLPAQLRRARADRRRAPPQRGGDPRAAQGGDDHLDADRRHLRHARHPALAEQPARLPARLPGIRPRTVRRRVRRYRPTARAPAHRPQRPAPPALPATRRLQRDRRRVHPLAGLVRRTRRRRRRLRPRLRHREPGHRPLRHRHRMRRPLPPAAGTRPRPGNLATLGAAAGDPAPPPGFLPGLVPRRRQRTRTAARRHREGPGAQRGNPSHGSSGGLPMSGPKVVRIVTREEAIATCERDLQRLDKALARWENQASRLAQLSDAERAAAHARRASLHALARTGTLAGRATTGEDRKRIPQARPRRTRRARHPPGRGITPATPPPPGKRQRPAPGPRRQARCRQRGSPANPASAGRRRPPRRRGSPARPRFCRPRQRPRRGTPQRSPARTRPAPEDRRNAHHPGTVARPPATGRPARTAPGAHRPAHRRTATAARRGQRPSVPRATGTRRSRTAPGAPQPAARQPGPRPRPGRPRTPAATPAPGTPARPRQRSRRPRRRRTRRTAPARRRLPARQRSAATRRTHRAMQRHPHRPPPATGRPRPPPGRAPGPRQPRLRSPRRHGHRLGADRQGRPAQTRHPRLRPGSRRQGRQRPPATARRRPQRQPRQPARPRHRNPLVRRVPTPPGPARRPGRRTQRGTRAGGGRSGVEGDWRGRAAGDGGGAAEGVVKGPAGASARHSIRAVHRLTPGCPLATLPARC

SEQ ID NO: 31761 - protein, 125 aa, Pseudomonas aeruginosa
KGYRSLDVGRTRSYALIDQLSEQESVEVVCSAFDVARSCYRVHRLRRRRVDARRVALRSQVNQLFNQRRGSAGSCSILGMLREEGVTIGRFRVRRLMRELGLVSKQPGSHAYRQAMLSGRISRIG

SEQ ID NO: 31762 - protein, 64 aa, Pseudomonas aeruginosa
SRSGSRQRVDLPPDFSTMSNLVESVFRAGDGSEKAFYRRADSRLPQAGGGRCAGEGTVSPTRLQ

SEQ ID NO: 31763 - protein, 320 aa, Pseudomonas aeruginosa
TGKQPIEEVARRGPPRHRVAESGRPGKRVSPTARREAVQEMQARTGISERRACQLIGLSRSVLRYQPRASVQNTELQAQLVELAQERRRFGYRRLHFLLRRAGVQVNHKRIYRLYRAAGLMVKRRRRRHGVAVERERLSLPSAPNQVWSMDFVFDALSTGRRIKCLTVVDDFTKESVGILVEHGISGFRVTRALDEMARFRGYPKAIRTDQGPEFTGKALDQWAYQRDIKLKLIQPGKPTQNAFIESFNGKFRDECLNEHWFCSLAEARIRIEAWRRDYNEHRPHSAIGNLTPAEFAASWRTRQQQLKQEKLISTPGPTN

SEQ ID NO: 31764 - protein, 857 aa, Pseudomonas aeruginosa
AAVLKLGAGQLGSFQPYLKPFRDWRDNGIGAMRTALDASKKIVALTADVSSFYHELSPAFMLDPAFISGVLGLELTEEQSKLNFLFIHALRAWAAGTPLKKGLPVGLPASAVVANVALIELDRVIEQQVAPIYYGRYVDDILLVMENGANFRSSVELWEWLFARAEGKLGWVEQQNHQQIRFQPAYLKHGDSESQIHFANSKNKVFLLADAPGQTLVDAIAHQIHQRASEWRAMPRLPRSANHVGTDLLAATQSDGEAADNLRKADALTMRRAGFAIKLRDFEAYERDLQPEAWSEHRRAFFQAYIQHVLVLPQFFDLAVYLPRVIRLATACEDFADLRKTINALEKLCRQVNDYCTTTIKASPPGNAIPHSEVITSWQNQLFASIRESITAAFPPQLSKAGKQAWDEHMADCLPMTDVDTALSWPLSAKGFQKEQGRLFSFDLAHLPFRFIGLPKEMVAQRGIPAKKSVVTCADATALLPSNVIEGNQVLAKWINLKGLPYGLLFATRPFNLPELFVLNKDAYATSGRTSMRAVVLAVRGFELGEKAPSFDNHGVLQIPDGASPRRYGIAVSSWKTRIESWTAAVTRRPDPDADRYARLCRLLDVAISQPQQSRYFVLPELALPAHWFIRIARKLQGRGISLITGIEYLHAGKARVRNQVWAALPHDGLGFPSLMIYRQDKQRPALHEEQELQRLAGLELKPDRPWKTPPIIQHGDLRFALLICSELTNISYRAALRGAVDVLFVPEWNQDTETFNSLVESAALDIHAYIIQCNDRQYGDSRIRAPFKDSWKRDVLRVKGGITDYCVIGEIDVQALRQFQSSYRSPSTLFKPVPDGFEINFDRKVLPIGGAEPSNT

SEQ ID NO: 31765 - protein, 95 aa, Pseudomonas aeruginosa
GPHGQRDRGPVSLVLRIFAEAPGTDIEASIILMSATQKAANLLATHLPFAVFNLYDNTWMLETEAVRRGNDVLASIRARWRDLGLVAHSTKNSCY

SEQ ID NO: 31766 - protein, 362 aa, Pseudomonas aeruginosa
LQHLGVFDVLHAVIGKFIQQGFEHGAGLLAVLAEHITPLDVVGALAAGERLLVESHVGDQIEYIQLATVGHGLLQDFEWNAVIGQFFKHSLLALSTVPAAQEIGERAELSLQCFPDIVLEQNAVILGDEFAVGVEVLRTLYRDTHAHIVDHILNATFAARSTGIATREDFSAASGIGDIGWQLLLAYCQCLDGFWRHYRLFRFGLVDHHGLAVEIRVSKQTRGALEIHDGEVELLVVLAQAGAATDDLLELGHRVDVLVQHDELAGFGIHSGGEQLGGGGDDRVKLVVVDEVGKLSLAFVVVTSDAHHVTTVASSSGYELDQLLPHPLGVILIVAKHDGFSHWVSSFEVFPHFAGHEPSALF

SEQ ID NO: 31767 - protein, 266 aa, Pseudomonas aeruginosa
HQIAVEILGVVLALFHRLAELVDLALLGGVAHGVGIGSNADDLIRREETILDALLERIRINRVTKVGDVADFLRFLGCGGQTQVGSTAEVVEHVPPGRVISSTSAMAFIDDHQIEEIGRELTIDLFPLLTPSYSLIERQIDFVVLLDLAISDLVHHLTKRGEILLHSLVDKDVAVGQKQNALLGLSLPQPPNDLECRVGFAGAGGHDQQHPLLAFGDGLDGTVDGDALVIARLLAASVGVKRLLDEFDHSVCDEPLPLLVKRPQIV

SEQ ID NO: 31768 - protein, 165 aa, Pseudomonas aeruginosa
SSACRESVAARRYDLVPAYASTLAFSFCPGRKVTTRRAVIGISSPVFGLRPGRWRLSRRSKLPKPDSLTCSLCSSAWRISSKNSSTNSLASRLFRPSSSYRRSAISAFVRAPIRYFLNVALNLSSNDVTMFCVVLLTSSSLRVRDGCCQVKPTARLFLCGSMPLP

SEQ ID NO: 31769 - protein, 151 aa, Pseudomonas aeruginosa
VRTSWPTGASAGSSSRPAFSSLICNSLAEQSMPKDSTPRSLAFLILKSPGSSAPIMAKGIFRPARTLGAPQTTWKVSLPLLTWQTRSLSASGCCSVESTSPTTTPLKAPATGRSASTSRPTMDRRATSSSWETCGFAQLRSHFSLNFILFS

SEQ ID NO: 31770 - protein, 175 aa, Pseudomonas aeruginosa
GIRLRSGLAELSEEAQIVIEEQTQVVHPVAQHGQALGAHAEGEALEFLGIDVGHAQHVRVHHAATHDFQPAGLLAHAAAVAAADHALDVHFGRGLGEGEEGRTEAHFELLLEEGAEEFLDGALEVGEADALVHQQTFHLVEHRRVGQVGVAAVDAPRADNADRRLLGLHGPHLHR

SEQ ID NO: 31771 - protein, 177 aa, Pseudomonas aeruginosa
GVGTQQHVRIEIESVVHGTRRVVARNVERFEVVVVVFDFRAFGDFIADAAEALLDALQRAGDRMQAAAQLATTGQGDIDALRGQPGGQRGPFQLGLTRVQRILDLFLGHVDQRANLRPLFGRQVAQGLHHLGQFAFLAEVVNPDLLQGIDVFGVSHSLQCLRDQRIQVFHVWTPDTK

SEQ ID NO: 31772 - protein, 714 aa, Pseudomonas aeruginosa
LLRVLATTPGNRLCQQLSELGDGHGAQVFPFARTHRDGLRFNFPISNNQEIGNLEQSMLADFKADLLVSQVGLGTESAFPEDPHHLGGEIGLLVGDIHHHCLGRRQPGREGSGVVLDEHADEALEGPEDRTVQHHRALAVVVLGDVAGVQALRQVRVVLQGAALPVTTEAVLQGELDLRPVERALARLVFPGQAGFVQRIGQRAFGAIPQLVGTDALGRTGRQLHGDVGETEVAVDLQGQLDEIGRFLLHLLFGAEDMRVVLGKAAYAHDPVQRAGRLVAVAGAELGEAQRQVAVGLQALVEDLHVARAVHRLDRVVAAFRGGGEHVLGVVRPVARTLPEDAVDHLRGTHFDIAMVALDLAHVLLEHLVDAPAIRVPEHHARRFFLQVEQVELLADAAMVALLGLFDALDVGRQLLLVGPGGAVDALQLLVLRVAAPVGAGNLGQLERLEEAGVRHVRAAAHVHVLLMEVQAHGLLVRHVVDQAQLVVFATGLEQLDDLGARGHLLDHVVVLVDQLAHALLDRRHVLGGEGALEEDVVVEAFLDHRADDHLRGRIELLDRMADQVGAGVADDLQSFLVLGRDDLQGRVAIDGVAGVDQAAVDLAGEGRLGQARADGLGHLGHGDRVIEGTLTAVGKSNDGHGASSPSGDPYQRPRGLGCASKRRPPGRPASQWQAPCGTPAPKRADGDHWEWILTKNAGADPARSAHGKASAAS

SEQ ID NO: 31773 - protein, 118 aa, Pseudomonas aeruginosa
AGSSPAEVTPMNTPIFYELFRNHPLHAPSARTLASMLALGLALAGVWALLLGWGIGLGIDNFAMYFGWTALLMTILLVALFLGATLLRMEAIWLAFLLALPLLTSLTGCLALVGAGPE

SEQ ID NO: 31774 - protein, 224 aa, Pseudomonas aeruginosa
LTKILSEAVRANCKIVRNASCDLPAGSVGKQRPAPRIEAAHPVQRRFRQRQRGRRTLARRLARQHQPFGASVVDAGYLDLGQIAAVLAQPGGAQFELAKTPAGHPPASLRKSRRSVTRPGVDQPARSASASRSSSRRVRTRQPRSVTSTVCSYWADRRRSRVVTVQPSLCSFTAWPPWLIIGSMVKVIPAFSRAPAPARPKCRTCGASCILRPMPCPQYSRTTE

SEQ ID NO: 31775 - protein, 229 aa, Pseudomonas aeruginosa
PSQFNLRRHYRAFADAQTTDYNPHFRVNSSGASMKSASFICDRRLYELLQESGRTTFTTRELRDAYAARLKGTHFRIADVRRYVYEQIRRLVRAGWVVPDEERRVRGQVYHLQPIPAHLQLELIDNGFEDSLMAAGVPEPETAARDVEALPLKSSANTDLQLEALHKEIRLDFLTSMGEAERFKLLLDEMPHLRDKVEGDYLEARDRSSRLLGHLRAIEKTLKTLAASR

SEQ ID NO: 31776 - protein, 417 aa, Pseudomonas aeruginosa
PRRGFRSSFGGNATGADANFVAIDLDHPQDVGVNQATEKSSFEFEGTLYDLVPVLHPHFRLEGGNRHCSVVDGGIDAADQRDFTAHKMRDGCIDLDGFDPWGRGARAYHIAGMEYEGVSLEGTALVRRLNDGHPTVWAKDTDSQVKVVVVSTVSVVHPPGADLDDLRRGRAFLQRDLVRVPGFVQGDHRLGDADRFRRGRGWDRGSCRLIVDLDSIHATEPDQARGETLPDRARLRLTVSDVELEYDDARLPLKCPRRKIQHLVAGKNTCAEVWYSCETSSGAILGQGDGDLRDRGWQATQIKADAVTDRAGLDDGRRECGRAGRMLRRIEEDHPTVIDHFSGVSDEEGRQVHVEVCAGRMRYQHLTFRLVDGGVLAGLEGLIQFWSPIPWFMCRQSKPGLHEARSHTRPFRAESPK

SEQ ID NO: 31777 - protein, 67 aa, Pseudomonas aeruginosa
RRGRGCTRSWRNLLRGLVLRDLGWYLLVLSSTLSFERLGGLTTLLEFDDCQLALILDLRLSSCFFSP

SEQ ID NO: 31778 - protein, 101 aa, Pseudomonas aeruginosa
CQPNSLSPQPPKQLHIGYFRGSDTALTAYVVALHNTTLGPHYLLAAGGYPQEPPTLATFHSCTKSDALCRRRVAASEHADSSVMGPEVMEKAATIPMSRSS

SEQ ID NO: 31779 - protein, 71 aa, Pseudomonas aeruginosa
MPLAAAISITAVRDSLSQPQAAWTSAPSGPWTVLTRRSPPVAARTASTVPSPPSAMGMHTISASGAESRTP

SEQ ID NO: 31780 - protein, 235 aa, Pseudomonas aeruginosa
RNAPGVCGLVPNPFGRQVKVFWGCHLEKDCRAAKVRSQPQSLGLNDGPLSRLARQEDGCQNVFDPLLEPNPVLLIISLGDQHLSGHSNHLSERAYLIRRTRYANNADHLAIQAKREVHPFLHAPESASGCVVDLNSPAVGEDQLGPFVAGIEALSLARPNDQALAIHHVHVSRKDGHRSVDDFLSEGVVKIEHVGGLHFVSGQCTEVGACHQPFEQLMEEFPSWIKEASAKGIIG

SEQ ID NO: 31781 - protein, 156 aa, Pseudomonas aeruginosa
CDSLIQFIRWRSVDGQTVTVGQGLQATSVALTNSAELPFAVVAVQLGEDHRGFSRGVFGQIVTNNLGAVGLVNDTDEGVADLTEVLATIFSVMDRHGEGDLVDVDRHAAQIDLDSLVVTVAGAITVVAGMLNGTVRTLELVVEDEVCIAADFTGGV

SEQ ID NO: 31782 - protein, 322 aa, Pseudomonas aeruginosa
TWRPQSSESRELSSRWFSAIRACVPLSERGPSAPPDQCLLGARRPAHPPAVGFVHILVPTVEVDSAGDLNGPVYVFKQGDGAHPIASTFFVQANFDFWLARDEDRHDAVGSFPVRSTFVDEREDQDAFDLAPLPAVDVHPLAASNRTSSVVAHQLNVGLIVQITEGLPQGLNNSLVAILQFEETPNVEVDGLALAKDAAEYTATSTLVPVQVHLDLTKPCSRLVQADARARLVERYLAEADGRLRRGWRYLRRRSGSRCRRGRRCSDFDAEVLCQRSQASREALGDTTKLPRSLPKVELTEDEGGFIHPVCWDLSFDPSSER

SEQ ID NO: 31783 - protein, 92 aa, Pseudomonas aeruginosa
YIGRSDISSSYIHMSQKYRMDCDPYCFNIIWNPLYPTLAPCIVIERANNSQSKIYGVFAKPATTHRPVTVCSQWARAQLKKTNISPVSIGSI

SEQ ID NO: 31784 - protein, 181 aa, Pseudomonas aeruginosa
VTVDTPDSYDKEMCNYLTGTFHIVPAWVIGHQRRCWQNGGRSNCARHDSTYQRAEADLHNLVPSIGEVNGDRSNFGFGWLPQKPQQYGACPMVVDFKARKAMPRPQIRGMIARTYFYMSDRYGLRLSKQDRQLYNAWHKQYPPQTWERQRNHMVGCVMGWGNPYVGPVDLATCSNLSSRRR

SEQ ID NO: 31785 - protein, 173 aa, Pseudomonas aeruginosa
PMIFRTLALLPLCAALAFAADAGERRFDCTVVAIHDDASLGCRLPGANKALRIQLNAVELPAAEPWRRRAREALEDMLLGKSATIREQGRDARFRILGAAWVTPADCPTCGHTLDAGLALLTIGLASWRDAPDSGQTAEARGQYRFAEEEARARKAGQWRPRDAAPRDGSPRT

SEQ ID NO: 31786 - protein, 344 aa, Pseudomonas aeruginosa
RRRRTNSPAVASQKGRDEFHPTENAWRQAAIGGRSSSARTQQGDGMFRTAYREIGLFGLVKRTVNEFLEDDMPTYASALAYQMLFSLFPFLLVLITLVGYLHLPEFFAWLREQAALLLPPEAMDQVNPVIDQLQQQKGGLLSIGIAVALWTSSAGIRSMMIALNAAYDVKESRPVWKRFSLSILYTLGIALLLLVAAGLMVTGPQVIAWIAGLVGLEQYLVTLWTWLRWPLAVFLLMLAVALFYYLVPDVEQRFRFITPGSVLSVIAWIAASLAYGFYVKNFANYNAMYGSIGAIIILLLYFYLSAAVVLFGAELNAVIEHHSEDGKDPGERELPDNDDPELKA

SEQ ID NO: 31787 - protein, 384 aa, Pseudomonas aeruginosa
VSTRRQLPGSHGHLPARRPAAAGQGGPGAARGAAERQRQARSPAVPQRLRRLPRRRRRGQAAYRGGDERQLRQHRPGRAAAAGADPPAARPGLGRRGRAGDHLHPRGGTAAQARHLRLLAGRSARHRGGRRRADGLPAHPLARRAPTAGMGLADSLRGRPAGPADRPVHPPQPGRDLCRTRPPGQHPEPARRIVRQSSASPAARSADPLRKHHHPLLPQLHDHLRPYRATPAGGHRDALDAGRRRRTGALGVARRRALRPLRAPRRADPAAPGAARGAVLGTACNDPSPRAGSLPRRPRPALGPAWHERRGADRAAGTKLHPGAALHRFFPGLCDRCHRVLRLRPHRGDLDDPCHRHSPVPAGLPAAGQPGSALSGAPGWPPNN

SEQ ID NO: 31788 - protein, 372 aa, Pseudomonas aeruginosa
VLDDSYRAAMATYLLGDQPPPAKVVQALPEAQLNDSGKRGRQQYLNVCAGCHGGEGEGKPHIAVAMNGNYDSIGPAAPLLLVLTRLLQGLAWGGEAGPATTYILEAAPPHKRGTYACWQVVAQGIAAVAAGLMGYLLTLWLDERQLQEWGWRIPFAAGLLVLPIGLYIRLNLAETFAGRGRQASTRNLLGELFGNHPPALLLGLLILSGSTITHYFLNYMTTFALTELHLPAGIVMLSTLVAGAALALSALLGGVLCDRYGRRAVLILPRLALLAVLFSALHAMTRHPEPAVFLDVLALLSALHGMSGAGLIVLLVQSFTRALRSIGFSLVYATGVTAYCGSAHIVVTWMIRVTGIPLSPLGYLLLGNLVLP

SEQ ID NO: 31789 - protein, 229 aa, Pseudomonas aeruginosa
LGKGEGGHVVEEVVGDGASGEDQQTEQQGWRMIAEQFAEQVPGAGLAAASGKGLGQVEADVQADRQDQQAGREGNPPAPFLQLALVEPEGEQVAHQPGGDRRDALRYDLPAGVGAALVRRCRLEDVGGRRPGLAAPGQALQQAGQHQQQRRGRADAVVVAVHRHRDMRLALAFAAVAAGADVEVLLATALAAVVQLRLGQRLDHLGRRRLVAEQVGGHGCPVAVVEYLL

SEQ ID NO: 31790 - protein, 689 aa, Pseudomonas aeruginosa
RRPPALPLFRRDRRGALRVVPRRADHPPSAGDGGAGGAAEGAPPVRRRRGGLPRHHERSARRGHRACRGDRFDPRPGQARQGHPGSQVRRRARRPRGQGGQGGGGVAAGRPGSGAGQAGRRHRRRDRPVQAGPGGRSRRHARAVEQARQPVAQGRTRAVRRLPDDARRCLHRQRGQAHHPYRPVGPGRPAPGGDGARAALRADGRRLSPRARLRRQGHRSPPARLPAGRTQAEPDLPGADHHRQRGAVAGDARRGAGRAPGRPGLGARLGQLARGDPRPCHGHPHGDGGGRPAVLQGRRHRPDRRWLPRRGLHQPLRRAGAPVQRRGRRGARAEQGPGGPARAALRDPRRPPHAALGQHRPARRCRPRPGAWRRGRGPVPHRSAVHDQRPLPQREGTAGDLPRAAQCLPPAAGDHAHPGYRRRQGAVLLPDQGRQPVPRLARHPRHPRPPGDLPGPDPRHAQGQRRTGQPAYPAADDLRHPRAGRGPAPDPPRLGRGARRGRGHRHAAHRHDGRDSRRRVPDPRAGPPGRLPFGRFERPDPVPAGGRPQQSAGRRPLRLPASGRAACVEEGGRRCPPGRQAGEHLRRDGRRSRGCRAADGDGLRQPVDERHQPAQGEVAAAPDHPGQGPGPARPVAHLRQPAGHPQLAAPGVAQPRPGSRDQPGGYRPALISRAPDASSCGAYAFPASV

SEQ ID NO: 31791 - protein, 332 aa, Pseudomonas aeruginosa
NSSRLAATSSGRACPGCQAKTIRHMRDPWDGLAVRLKASAIAVQARRLPHGAQFRYHAGFPTGACMEFLLYIVLGACAGVLAGLFGVGGGLIIVPALVFSFTAHGFGGDVLTQMAVGTSLATIVFTSINSILEHHRRGAVRWPVFAWMTLGILIGSALGALTAAQIKGPLLQKIIGVFAILVALQMVLDLKPKGSREVPGKGGLTLAGAVIGWASAIFGIGGGSLTVPFLSWRSVPMQQAVATSSACGLPIAISGALSFIAVGWHNPQLPEWSLGYVYLPALVGIAATSMLFARFGARLAHRLSPRVLKRLFALLLFSVGISFLTPDLAFLS

SEQ ID NO: 31792 - protein, 269 aa, Pseudomonas aeruginosa
ELSMLTYPQIDPVALAIGPLKIHWYGLMYLIGIGGAWLLASRRMKRFDPTWTKERLSDLVFWVACGVILGGRLGYVLFYNLDEYIANPTLIFEVWKGGMSFHGGLLGVMLAVWWFGKRHGKSFFQLMDFIAPLVPIGLGAGRIGNFINSELWGKVSDVPWAMVFPNGGPLPRHPSQLYQFALEGVALFVILWLFTRKPRPTASVSGLFVLCYGIFRFVVEFVRVPDAQLGYLAWGWLTMGQVLCVPMVLAGIALMVWAYRRDAAQPKAA

SEQ ID NO: 31793 - protein, 377 aa, Pseudomonas aeruginosa
  UNSURE (59): Identity of amino acid at the above locations are unknown.
TDRRPSGRRAAAGRRRGRRPWRRRRAAATLPRRPARACAPAGAGRGWLPARRFRRRAPXAGRRRGRPAIRRSAVARRAGARRPGSHGRRSAGRVAAGRAPSAAPGSRIGAVRRPAAAPRCRNAPRRAGPCERGRRATPPRDAAGWRRSSAPAAAAGRSRRAPPVRRDTWPAPVRGRRSRRARRRRRATGRPHWLPVRNARAIRCCPATAPCVPGHRDARRGAPGRPGSRAGRWRLPGRACRRVPAALRRPPTAWRPRRGGWCWGDGRLRRIRGRGSGCAAARSCRYWCGRPRPGSAAQSWPVSSQASGEVSPCGSCRRSRAACQSPKRSLSSASPGGAWSSQMRVLAAQRASSPSSARVPRSGERRGSQAMARRAGG

SEQ ID NO: 31794 - protein, 669 aa, Pseudomonas aeruginosa
AAHPRYRYFAETGEERYASFLGAPIIHHRRVMGVLVVQQKERRQFDEGEEAFLVTMSAQLAGVIAHAEATGSIRGLGKLGKGIQEAKFVGVPGAPGVRVGKAVVVLPPADLEVVPDKQVDDIDAEIALFKQALEGVRADMRALSSKLASQLRKEERALFDVYLMMLDDASIGNEVKRIIRTGQWAQGALRQVVMEHVQRFELMDDAYLRERASDVKDIGRRLLAYLQEERKQNLTYPEQTIIVSEELSPAMLGEVPEGRLVGLVSVLGSGNSHVAILARAMGIPTVMGAVDLPYSKVDGIDLIVDGYHGEVYTNPSAELVRQYSDVVAEERELSKGLAALRELPCETLDGHRMPLWVNTGLLADVARAQERGAEGVGLYRTEVPFMINDRFPSEKEQLAIYREQLSAFHPLPVTMRTLDIGGDKALSYFPIKEDNPFLGWRGIRVTLDHPEIFLVQTRAMLKASEGLDNLRILLPMISGTHELEEALHLIHRAWGEVRDEGVDIAMPPIGMMVEIPAAVYQTRELARQVDFLSVGSNDLTQYLLAVDRNNPRVADLYDYLHPAVLHALKKVVDDAHLEGKPVSICGEMAGDPAAAVLLMAMGFDSLSMNATNLPKVKWLLRQITLDKARDLLGQLLTFDNPQVIHSSLHLALRNLGLGRVINPAATVQP

SEQ ID NO: 31795 - protein, 289 aa, Pseudomonas aeruginosa
TWPSFCHPSVGAATSAPHRYRSEPPMKQYLDLMRHVREHGTFKSDRTGTGTYSVFGHQMRFDLAAGFPLVTTKKCHLKSIVHELLWFLKGSTNIAYLKEHGVSIWDEWADENGDLGPVYGYQWRSWPAPDGRHIDQIANLMAMLKKNPDSRRLIVSAWNPALIDEMALPPCHALFQFYVADGKLSCQLYQRSADIFLGVPFNIASYALLTLMVAQVAGLQPGEFIWTGGDCHLYANHLEQADLQLTREPLPLPSMKLNPEVKDLFDFRFEDFELVGYEAHPHIKAPVAV

SEQ ID NO: 31796 - protein, 394 aa, Pseudomonas aeruginosa
STRRLPSSPDFPRAGRFVVRRLRFPRKRIDCLPFGRGHWPVERARDCRKMDERASKPPGLLPLSREDLEKTLRYALEIVSDGIWDWNIATNQVSRSAGWYLMLGYPPHSLPESVETWKNIIHPEDYPRVMASFQAYLDGESPEYCEEYRCRTYSGDYLWISDRGRFVEFDERGEPRRMIGAHHEIHQRKLVELELQQRNEELFDWNLRLEDLVAERTEALHRVNQALASKMAEAQRLSEIDPLTELYNRRKFEQCLHHEWMRRQRHGRATALVMIDVDHFKRINDLFGHSTGDRVLVAFGRLVASELREVDVLARWGGEEFILLLPETGLEAAAALAERLRQRVRSQSFEMGERLTASFGVGVLNDGETLDLLLCRVDDALYRAKQRRDCVACC

SEQ ID NO: 31797 - protein, 422 aa, Pseudomonas aeruginosa
RSAWRQHQADLAEPGAGRPEAALDHLPRAVGVYPYDAAGASAVARAGDEHAGEQAFRGQTHAGIRQLAVGGRRCVGQQLQQGLRMRLGKPLGEGGASLEQLRPGRIEGRVGQPVDPRRQQARWPYAGVVVPELMAIANEQVEAGIVRGAPGDLRQVVGRVAAAAQEVRHQFATGALAESLRRIADVGQGGETAGRAEPQPGAAGLQVASGEYPLGVLPGRQRQARAGIEFVTVGGDQQRQGVPRLPGEDDQAHARSLGWAGRQAKGIRHRRSSTTPAARRAIPLPCRLSNGGVHGVSPLYRAGRLCRRAGRTVRRRRRPDHRPGAGLQLHRARFRRRRPDPDGGRHLPGDHRLHFDQFHSRTPSARRGALAGVRLDDPRHPHRQCPRRADRGADQGAAVAEDNRGVRHPGRFADGSRPQAQG

SEQ ID NO: 31798 - protein, 477 aa, Pseudomonas aeruginosa
PRGARQGRPDPGRRGDRLGLGDLRHRRRFADRAFPQLAQRADAAGGGDFLGLRPSYRHFRRSVVHRGRLAQPAVAGVEPGLRLSAGVGRHRRHQYAVRPLRRAPGASFVAARTQATVRPAAVQRGHKFPDPRSRFSVVGVIDADVSPDRSGCAGHRPAEDPLVRADVPDRDRRRLAAGVAPDEALRPDLDQGAPFRPGLLGRLRRDPRWPPGLRAVLQPGRVHRQPDADLRGLERRHVLPWRPARRDAGGLVVRQAPWQELLPADGLHRPAGAHRPGRRAHRQLHQLGTVGQGQRCALGHGLPQRRPAAAASLAAVPVRPGRRGAVRHPLAVHPQATADRLGLRPVRAVLRDLPLRCRIRPRAGCPARLPRLGLADHGPGALRTDGAGRHCPDGLGLPPRRGAAEGGLSRFSCPGRITSQASSAPGSRLSAPGRAWLAPVAPNWRCRLRRRRLGHPSVIPRWEPPRRRRTDIDPSLR

SEQ ID NO: 31799 - protein, 154 aa, Pseudomonas aeruginosa
  UNSURE (34): Identity of amino acid at the above locations are unknown.
SRSNASTQACSRLRTCWCRSRVASCTALSPPGTXRRQAARSTSNSAISRCPARRRAAAWVSWSAISRSSCGRARSISSARLSYRRRSPSSGGATLSKRTKACRPMRARAARHSSSRCCGLATKFSTGSSGRPQPASTASSSRYLASTGSRASIT

SEQ ID NO: 31800 - protein, 251 aa, Pseudomonas aeruginosa
  UNSURE (6),(12),(163): Identity of amino acid at the above locations are unknown.
LFLFTXGRDYPXACGPAPLRFRLGNHHSRQRYLHRPYPGARRPAGVAWLPVAGRRADPRQRRRRPGQRSRTARLGRLAGRRTAGLWGPAARAARSALPVALETRPGPPRPGPRRPRLQPAARTLDAGQRTPRRQRRGTGLAAGAAGRPVRPGSRRSGAGGGGXGRSPALAAEARRKRRRRRDPRQRPAAPSPARTTDPLPAGAPGHRLRPASLAGPRHPGTARRTRPLRRQHPHLAAPGSARRSARQRPLG

SEQ ID NO: 31801 - protein, 140 aa, Pseudomonas aeruginosa
  UNSURE (13): Identity of amino acid at the above locations are unknown.
SPNCWSTSPPAGXWCPAAKAPCRKPPATCTSRCASASRPAWKRCCGSTPSPGTTPAPPTCRCSTAAGATICSIRRPCANSVSASAAGLRPVPRPAPASTCWWAASPLAPPPPSVPSPAAPGRPSATTARACSASSRAPAS

SEQ ID NO: 31802 - protein, 304 aa, Pseudomonas aeruginosa
TAGGWAAATARNRSTRWPNCWRAGAGNDRLGDDRPRGRPMPFVSYAQNLEDVRLWRALKLFPRGFYIDVGANHPRIDSVTLAFYERGWRGINIEPLPHLHRELERERPEDLNLNLAIGEREGRATLYEMAASGLSTLDPELARQRQAEGCTTTPREVKVSTLDAICAAHVEGPIHFLKIDVEGLEGAVLRGLDLNRWRPWLILAETPFDHDPEWKAPLLAAGYRFVHFDGLNGYYLAEEQARLEGAFALPPNLLDDFQLCHGHAMSHPVAPLEQALEQALQRAEDAERALRDWRALPWYRRLFG

SEQ ID NO: 31803 - protein, 317 aa, Pseudomonas aeruginosa
QKDGQVYGDGACIASSARPAQAMHALERKAGCPERMTPATLSAPGTKSGSGRLRLRRVAAVGPDHQGNAGQHHRYAEHLAHGQPTPGEVAELGIRHADEFDNEAEDPVAQHEQAGDRGGRPWLAGEQPEDDEQRHAFQGELVQLRGMPRQRAAVGEDHGPGHIADLAPQFRVDEVADAPGAQADGHQRGDEVHQLEEALAMALAEPPDRQHHAEQAAMEGHAAFPDLEDQRRVGDVLVQVVEQHVAQAATEDHAAGDPEDQVGKALLGPGRVEALHPARRQQPGAADPDQVHQPVPVDLQRADGQRNRIDLGIRQHR

SEQ ID NO: 31804 - protein, 298 aa, Pseudomonas aeruginosa
LLRQKSEIGGQETYAHAEQQQGEQSLEYARRQTMRQARAEAGEQHTGGGDADQRRQIDVAQAPLRQLRVVPADRDERQSAGNGDRKAAGRGSRHRLLHRHAAPTEERHGQRTAADAEDRRGPADHRAGQGQAALAGHLAATLGLEVENHLQSDQDGEHPDYLLQQRPLDLRRGQRAEGTADEDAEGHPGEHRPAHRAAPMVFENGIDRSEDDGRQGGADRHLGQDVAAETVRGEAEDQRRDDDQAAADAEQSGQHAGTGAQHDIEEKLHARPRWKAGMVTELRAVRQASCLNGDGGCL

SEQ ID NO: 31805 - protein, 304 aa, Pseudomonas aeruginosa
RILCPPEPAAGGLGGRRGGIRRTRPGGRRHLAGARPGRPFRRPDQRPRSVAGSRQALPWRTGGGLPARRRQPGRLPGAGRRARRGLFRLQPAHWRSPSALALQPPRRATAPAAGGDLRAVQRGPRYALAEAAQGSRRPRRAACRAASAGPAGAAGRRSAGRRRPVAGYRRGSGHGTPALQRVHRQPELRHSRQQRRTGTRRRHAGDDRAQLRAVRRPARRGQPGAAARLTFSNRPRNRDAAWPDRGRRPRGTAAGRGSRHHSARRRQSWRSTARPSRRTASEPAGAGVRPRPPRPPGRFPGAAG

SEQ ID NO: 31806 - protein, 272 aa, Pseudomonas aeruginosa
  UNSURE (5),(6),(156): Identity of amino acid at the above locations are unknown.
GATIXXPAGQPRYGFVWETTILGSDTFIALTQALGALPALLGFPLPDAELIRASGDAALASEAARHAWAGWLVGVLLVYGVLPRALLGLLCLWRWKRGLAHLDLDLDDPGYSLLRERLMPASERLGVSDAAPDWLPEPQGGQSGQEAAGAVLVAVXLDDRRPWPPKLAESVADAGILDNGQQRRRLLEQLTRYPPARLAIACDPRRSPDRGTLALLGELARCAASTRIWLLQAPPGEALDSDRLGDWHAALERLQLPHGETSPLAWLETGHD

SEQ ID NO: 31807 - protein, 211 aa, Pseudomonas aeruginosa
AADPGRGRPHQYRQDLAAAHPDPRPRIRRSLPSPQHHPPRRGRQAVGGRRSAAGTLRHARPGRRHRPARLPGRPGAPRRASRWPGTHGAVAGQQRIARAFRTGSQCGRPVARLRRRALRDRRPRTGAGQVSRRTGGARRLRPAAAAGAELRRQPAASRGGVARRPRSHGPARLGAFRQRGAAAGRRTAPIREPGAADGARPAATRPADRRP

SEQ ID NO: 31808 - protein, 275 aa, Pseudomonas aeruginosa
  UNSURE (27): Identity of amino acid at the above locations are unknown.
DPGRRAPARRATADRRIAGRPRRLPAXGARRRKRRAGSHPRPAPAGAQARAGLRGSVAAALRLRQGRRPRRRPAAARRPLGRRSVQSGDPAPTRYPPRRRGCGRCRGRRRHRPAGGRRHPWRRRRPRCPRRRRLADRRPLRLAPARQAQGRPRADRQRRRAALARAAPTAAPGSPANARPRGGRGDPPGNPGGQAVARRQAAGSAAQGARASGVVVAERQAGGRQRPPGTDRRAGRIAGERARGMTDWATIAQEVGPCPSFPTRRTWKTSDSGGP

SEQ ID NO: 31809 - protein, 204 aa, Pseudomonas aeruginosa
PRLHSGNCGLCQPTAMNDRAPEMAIGRPQAEEVATACCIGTLRQLRKGTVSEPPPMPKIAEAQPITAPARVRPPLPGTSRLPLGLRSRTICKATRMANTPIIFCNSGPLICAAVSAPRALPMRMPRVIQANTGQRTAPRRWCSRMELIEVKTMVAREVPTAIWVRTSPPKPCAVKLKTSAGTMIRPPPTPNSPASTPAQAPSTI

SEQ ID NO: 31810 - protein, 269 aa, Pseudomonas aeruginosa
TAMADAFSLTASPSQGSRMCLIVFAWQPGHALPLLVAANRDEFYARPSLPLAAWEDAEGVFAGRDLEAGGTWLGLGPAGRFAALTNVRDPSQALGKRSRGELVADFLRGGGNPADYLAQVAGRAADYSGFNLLIGDRHQLWHYNPRVGPPRLLPAGIYGLSNAALDTPWPKLLKARAALAERLAEPHPQALLELLADAAPAADGQLPDTGVGLATERLLSSVFIASPSYGTRASSVVRVHADGTREMIERSFGPSGARLGEVSLVLPPG

SEQ ID NO: 31811 - protein, 332 aa, Pseudomonas aeruginosa
PSATGHAIATLLGPIEGVVHAAQQQVEGLAIIQHADAKAGGQPLAHLEGLRANPLAQAFGQGRRGLQAGFREQQDELLATPARQHVDLAQLAGNQAAEGDQHAITGGVAEQVVDPLEVIDIDHHQCRGASMALPAHPFMVQALLELASVVQLGERIDFAQALGLGHLRGQRLVDPVQRLGALGHQVLETQVPVEQFLVALLQLQLDQLALMDLVVRTDHPPRLAALVELDETPAIADPQVIPAVGAAAVFLAVFRAFAVEVGLEAGHHPRIVLGMDDVLPGLHALRQAMRRIAEHQVPAGAAADLVGRDVPVPDPVADDLQGISQGFLKVFA

SEQ ID NO: 31812 - protein, 161 aa, Pseudomonas aeruginosa
SGAAATSPWAGWWRSSTGCRSPSPSAARQPRDRRPSRRRCSPACLPGGHRRPPSSTHAARPDAGSRRGRRPADCCGRPPAGTGSGRSNRPKGSRPGGPARGSGTRRRESRPSCRWAAWRCPRPRRAPRPRRGGSGAGPLPARGCRRSSAAGYAGCPVLRWP

SEQ ID NO: 31813 - protein, 539 aa, Pseudomonas aeruginosa
  UNSURE (322): Identity of amino acid at the above locations are unknown.
PATRRRAWPSPATRVARRTAAPWHCSANSPAAPPAPASGCSRLRPAKRSTATAWVTGTPPWNACNCRTARPRRWPGWRPAMTEPLILAVVGHTNTGKTSLLRTLTRDLGFGEVSHRPSTTRHVEGARLSVDGEALLELYDTPGLEDAIALLDYLDALERPGERLDGPERMARLLDSNESRGRFEQEANVVGQLLASDAGLYVIDAREPVLAKYRDELAVLAGCGRPLLPVLNFVASPQHREEEWRAALARMGLHALVRFDSVAPPLDGERRLYESLALLMERARPQLDRLIADHETQAAARLRAGQRLIAELLVDLAACRRXVPGGESAVQEATRDLHQQVRKREQACVEALLRLYAFARDDARAADLPLLDGRWGDDLFNPETLRQLGIRLGGGVAAGAAAGAGIDLLVGGVTLGAAAALGALAGGAWQTVGHYGSRLLGKLKGARELTVNDAVLRLLALRQRQLLAALQTRGHAAVEAIRLETPEDKQWREGKLPEALRKARAHPEWSSLNGRRVGGSDRQEQIDALAELLESGRGE

SEQ ID NO: 31814 - protein, 685 aa, Pseudomonas aeruginosa
AHALRFLRAEPGRRPTLAGPETLPQGVLHRRRRQPPADRLGHPGVLRARLARHQHRTAAPPAPRAGAGTAGRPQPEPRHWRARRPRHALRDGRLGSLHPGPRASPPAPGRGMHDHPARSEGQHPGRDLRGPCRRADPLPQDRRRRAGRRGAPRPRPEPLAPVADPRGNSIRPRPRVESAAARRGLPFRPLRRPQRLLPGGGTGTPGRRLRATAEPAGRLPALPWPCHEPSGRSAGAGPGTGAATRRRCGAGFAGLARASLVPSPVRLSGADGSAEGSDRDRCLDVRMGLVADQLEVLEAKVEQILHLGIQLHARQRQRLAGQLQVGLLQVVGVQVAIAAGPDELARLQAGDLRHHQGQQGIAGDIEGYAEEDVRRTLVELAAELAVGDVELEQRVAGRQGHLVDQRRVPGGDDQPARVRILLQHRHQVGDLVDVAAVRRRPGAPLVAIHRAEVAVLVGPFVPDRDAVLLEVGDIGGALEEPQQLVDDRLEVALLGGHQGEARGQVEAHLVAEHAIGAGAGAVALEGAVLAHVAHQVEVLFHRRLGSISVRRRRGGSHRGMTEGWPSLRRRSLHRQFGATGASHARPGAESRLPGADDACDVIRPGHEKRLRPPSAAPRRGGRPRPSGQCRPAPSVRRAPGPWSANPRRGSRAGHPARGRIRQRSGRSRSTARTGRRPRRSAVACG

SEQ ID NO: 31815 - protein, 144 aa, Pseudomonas aeruginosa
SPSAGRSSCHGACRTTRPPASRRAGRHGRTCRLSRPRRSASGWRCTRPGCRTARSPGGHRGSRRRRPRRPGRKGAPWSRSGRSASSGATPAARRRRSRSGTSARTSGSSAGRWPAQPDRSGDTSASITPTTEKRDRGSGNLCPR

SEQ ID NO: 31816 - protein, 764 aa, Pseudomonas aeruginosa
PSIRYQPALRLTWLVAMFQSQIPSLTISRAYRRVFSRSSRDSGRRPGGFDARSSILRQSLARSTGQWPLPNGRQSIRLRGKRKRRTTKRPARGKSGLDGSRRVDHATQAEVAQRQVQRAVDDLRVVEGEQLAEQVPGLVQGDLAQQPLHLGQVGGVHRQAVEAHRHQQHGSRGIAGHLAADAHRLAFQVGIVDHLLQRMQHGRMQVVVEVGDPRIVAVDRQQVLGQVVRTDRKEVDLAGQLAGLVHGGGNLDHHADGRHGDVHALVAHLAPGAVDQVQGLFQLVGAGDHRQQDTQVVQSFAGLEHGAGLDQEDLRVVEGDADAAPAEERVVFLDREVGQRLVAADIQGAHGHRQRVEGTELLAVDRQLFLLAGEAVVDHERHFGAVQAHALGATLLGAGDIGEQAGVDPKRHAVAVEGLAGQLAQGRQALAQLALLGDHVAVLAHQLGGGVGVDLAVVAIDDQVDAVDLGVRQVDRPHHRGDAHGTGEDRHVRVARAEHRDQADQAPFRHLAEHRRRQLLADDDGLLRVGQVLLAFFLQVGEQAATDVLDVGGALAEIGVVHQLEALHVLHHHLAQGALGPLAGTDDALDLVADGGIVEHHQVDVEQRAFFLAQLAGELARQRAHVGANALQGLLEQGDLGVDVVDLLVRHHFQVGRRQHHHRLAHPDPGGAGHADELGFLDALAELAQAADRTGRLGMRDDPGELSAHGDEEGLLAFVELAALLLLHHQHPHHPPMVDDRRAEERRVALLAGLGEIAVARVGG

SEQ ID NO: 31817 - protein, 462 aa, Pseudomonas aeruginosa
GRRATAESRVFHRSPARCCVPRPGRSSGVVRRRRSGAPGTRHVPAGAAAARPGRRAGRAGWGRPVRNRARRPHRGRSAPVAARPGTGTARRLPAAPAGRTANRSGTAGRARASGADRRRAAGRNRRRRRRRLASGRPIQRTGRRRAPASRRAPAGHGGRAGRVSTRRAGPPAGSRPAAGRQRSWCFAPRFHGARRLARPERRQRQQQTDQRVGGAAVKLVEQRAEQRPADQAEAMYGHQGAGGGTLFLGAHGIGVEHRDCREYPTHARRGDEEGQPEQRRRVGEAHGGEADGGDQPADPDQSRRWPVQAAHQELGQDQRDAHCGQGDAGHPRGVGGIQAQPVEGEEAHGDLRHGDAEHRHEAHRQRPPQAAVADRQGGAAVRLATLLARQPAPERQQGDQGQRAGDQQRQDQPVSRQQSGQPRPDHHAYRAGRAESGQRRGASLRLDVIGHQCRRAGRHRGV

SEQ ID NO: 31818 - protein, 328 aa, Pseudomonas aeruginosa
TAGEAAQENNTGEGEQGRQRPVQGEHDEQAERGLGEGEAGQPAEQYPPSPMPVAGDAPGPRREHPGDAADGHRGAGLPGRQAELAGERADQGDEGHHREGADEGLQHQRTQVQGVGGGRRGGHLRGSFGFAAGAARPSRPAPAECPGRARRAGRRGRRRAAPRAARRGRAGPVAGASGRSSRDRASCLALRRQAAVRQFRQALLQWRLASAEPEVETAGEDDDADEVEQRPDDLQRHAAVVAEVQRLRQQERLHVQRHLAHVGEFAALRVDQCRLQQALGERRVAAHEHRIVMLAAELGAGEADEADLHVRRRPACRGQGRVERAEAL

SEQ ID NO: 31819 - protein, 277 aa, Pseudomonas aeruginosa
RASSASTSASGIRSAISMPRVQASGRPSKTSRRASPSAPRRTDSPLSSQRPRPWSGLSSTRPASTATRVAAISWRTLKRAAPACSRASAVATRNGRGSARLSTKISPRSRRTSRWLASKARSTALSVFRVSRLPSGRVRRRCSPTPVRWSASQSRNGSACQVASPSEAPPRTRARCLIARRRSSPCSRPRVGRASAGGSRPRHCSRRSARSQAWACCGLRCRHWAQAWRVSSVQPLSCRRTSHSAASSRIGEGIRPSPAAFIPSAPGTGGRPAACSA

SEQ ID NO: 31820 - protein, 499 aa, Pseudomonas aeruginosa
RPRGAASGVIAALGDGVLVGGVRPRGFQVPLGLVAGDVEVADQLSAHAADIAVAVVRVVLPFAVQVVVDHQLVEEIVGLVVLDLAPAIGRYHFQGHDLLPEARIVALHPGGAFHIALAGILLAGRVDRLLTPVVGELRVLLAGLRQSHVDDREECLDRLIPLDLVEPSALQAGVLGVERGEDRRRLRRVFLPLGQAQFVLGGEGFVGDLRHRPDALVEGRAGGGIALVADVEGALPRMVAAVLPVVRRPLLGGADVDVLAGLLDAVRRAPRIGATLLGAVVGGGVDGEGTEHRIVLVVLRITEDGVEDEATLQAIGELAVLGVLAQVGGGDAAAFLALRTDAVEHVVGRRPGGAEQYAGTEECRLRRSAAILAGVVVQLVEPGDHVVAPVGLGRGCQRQAGGGEKVEKGGSASVHGMDSTQVRRSGPGAARLVPMGTSATGGSRGMKRLRRHGRRRWDVSGTWWRQSATGRCRECRATPAGAGRRGPAERVGEVARGRR

SEQ ID NO: 31821 - protein, 423 aa, Pseudomonas aeruginosa
SGSRSPRAISRQFRSEGMPMLSASPSASGWRRTIGLRLRLLATAVAQRVGQLRGQPWQAWLPGRQGVGNDEVEAAPHVLAEALQQRRQAQSLHAQPGAFVYPGQGVAALVFVFLSRIDDGPGHGGERDAVVGENQRKAQGLGRLAQGIEVARGFHVLADHHACQAGLGQFSDVTPLPLGVARYAQPGGHQQVTLAEPFGGVVEFADMRPANRAVEAAGSAQQARTEFGEGDQVADALRHVQETPGMGLQCNRPGRRQRALSPTGGQHPQCRGDRVDPAGGEHQDDQPLYQRMGIPAAAECRQLVAVAPRRVEQEDGDDAHQYAAEGTGEVQRVHEAAEPRIGQQERRDRDRGEHRQAFAPVGFAAHAEVVEDIGEQAPAESPVRGQHRQPGESVRHVVGPSAEGASPAQGRHLADVVRGDQGR

SEQ ID NO: 31822 - protein, 1419 aa, Pseudomonas aeruginosa
GTDPRPRAGRRRGPAGGPALGTQLHLPRRAQPHRRPAPRRSLPAPRQQPIALEPQCPLQRPVAHRIRRQPGGLQQQRRLRLAGLQPVAPGAEPETQREPDAARRHREPWRPAPGRRRHALHLCRTWADLPSRPGGELLMRRSLLFCGALLASLCAWAEPAQVRLLSSDFVLPGKHQRLAGWAREAGVELRGLRLGIGEAPPGEWLDGGNLLILDTPRPTDRAQVEEALGERLQGGTQPWIRVGGGPPGFGNLPAALGGRLVGYYANGGEANLRRLFEAVQRWHAGLPVDALPAPQPLAQAGFYHPDAPAPFAGLADYLAWGASRWASDAPRIAFLIPRGAIADAQTGAIDELLRRSERHGQAPLAVWFDDSDPEALRKSFAGADVQALVNLQHLQNGPARRAEFLALDVPVLQTLGYRDGNEADWLAAASGVAPRTVAAFLGMPETWGMSDPLVISALENGEPKLMAGQAEALLDKLDRLLRLRRLPVADKHLALMFWNHPEGEKNVAASHLNVPASLARLGEALRAAGYRVATSDESALIDTAQRLLGGYYRPQTLDALYRDGLAASLPLDAYLHWLEALPADLREEMRARWGDPRRHWALRDIDGQRRFVFPAARLGNLLLLPQPPRAGRPGEAYHDSAVPPDHLYLAVYQFVREGFGADALIHFGTHGTQEWLPGKDRGLAVGDYPLRTLGDLPVFYPYIQDNVGEAIQARRRGRAVTVSHQTPSFAPAGLYDELRDLHQLIHEYQQLDEGAVRERSAEQIRAAVRAAHMNDDLGWSEAAMREDFPAFLGVLHDHLHRLAGSAMPLGLHTFGVAASPELRLGTVMQQLGEPYYRALGLDPDELFAADFRALREGRAYRTLQRYLRDGGEIAKVADPRLREQLLRARELDRQLADTGELEALLAGLAGRFVAPGPGGDPIRNPQVPSGRNLFAFEADKVPTRAAYEAGAEAFGQLLESYRAEHQGRAPEKLAFSLWSSETMRHLGIVESQALHALGLRPRWDAGGRLLALDIVPAAELGRPRVDVVLQVTSVYRDQFDGFMRLLAEAIERLAALDEPGNPLARNSQALERRLRERGVEAPLAQRLSRLRLFGNAPGDYGTGVTQLTLDSTRWDDDSALAEQFLGRLQYAYGSRDWGVKLDGGNLFAEQLKGVQAAILSRSSTLNGVLSTDHPFEYLGGLSLAVRHLDGASPALYIADLRQRQPRTTAAAQFLASELRGRYLSPQWIAAMQREGYAGSLEMLDLANNLWGWQAADRTMVRADQWQALHDTFVMDRRELGLAEWFETHNPTAQAQIIARMAEAIRKGYWDASEQTRRELAERWRQLAAAGAGEVGAATTREFIERMAGGFGEAAAQAEGAAASGAGETVSGRVLEEVAPPPSGEPQPWLRLAAAVLLALFAAGAVRQSVVNRRPMENRS

SEQ ID NO: 31823 - protein, 927 aa, Pseudomonas aeruginosa
SWPWSPPASPSSSLPCVAAGCSRNCAPSNARGRPADALPRTRRGGRPDPLDGQPDRPVPGGDRHPPDRHRAEPAQPVQPGQGGGGRESRRGGHAHAGQGRQGAEALPGQRRDRRRAGQPRRGDLPLGRRTDDLRAGERRGGRQVATRTAESWDFCPEFPDNGRFPFLLVLAVEVKVNFLDNLRLEARFDDFTVIADQPIRYKGDGSAPGPFDYFLASSALCAAYFVKLYCQTRNIPTDNIRLSQNNIVDPENRYRQIFKIQVELPADISEKDRQGILRSIDRCTVKKVVQTGPEFVIEEVDNLDADAQALLMPGTDAAGCTRIPGKDLPLEQTIANLSAILAGLGMKIEIASWRNIVPNVWSLHIRDAQSPMCFTNGKGASKESALASALGEFIERLNCNFFYNDQYWGEEIANAAFVHYPDERWFKPGRDDALPLGLLDGHCLAIYDPDGELRGSHLYDTNSGNVQRGICALPFVRQSDGQVVYFPSNLIENLYLSNGMSAGNTLAEAQVQCLSEIFERAVKRQILEGELALPDVPPEVLAKYPGILAGIRGLEEQGFPVLVKDASLGGEFPVMCVTLMNPRTGGVFASFGAHPSFEVALERSLTELLQGRSFEGLNDLPQPTFESHALTEPNNFVEHFIDSSGVVSWRFFSAKADFPFVEWDFTRQGEAANAEEAATLFGILEAMGKQVYMAVYENLGATACRILVPGYSEIYPVEDLIWDNTNKALAFREDILNLHRLDDAALGALLERLEDCEVDDYTDITTLIGVEFDDNTVWGQLTILELKVLIGLALKRFEDAKEGVEAFLQYNDNSVERGLFYQALNVVLEVVLDDELEIADYEANFRRMFGDARMDAALGSVDGSVRFFGLTPTSMKLEGLDRHLRLIDSYKKLHAARARMQPLVDGEAGAAAAGGLKPRRMAIRKRK

SEQ ID NO: 31824 - protein, 794 aa, Pseudomonas aeruginosa
FHHEEIEFVSWHESPENPSIDLSTGGTPMALAHTLGFPRIGRDRELKKAQEAFWKGELDEAGLRAVGRQLRAAHWQVQKDAGIQLLPVGDFAWYDQVLTHSLTFGVIPERFRAHGEAGPTLHTLFGMARGVSDDSCCGGAHAQEMTKWFDTNYHYLVPEFSADQQFQLSWEQLFEEVDEARALGHQVKPVLIGPLTYLWLGKGKGAEFDRLDLLDRLLPLYGQILRRLAGQGVEWVQIDEPILVLDLPQAWKNAFERAYNLLQSEPLKKLVATYFGGLEDNLGLAANLPVDGLHIDLVRAPEQYPSILDRLPAYKVVSLGLVNGRNVWRCDLEKALEVVRHARERLGERLWVAPSCSLLHSPVDLEREDGLDAELKSWLAFAVQKCREVAVLARAATEPEAAEVLAALEESRAVQASRASSPRIHKPAVQARLAAIKASDAQRRSPFAERIARQRAGLDLPAFPTTTIGSFPQTSSIRLARQSFKQGKLSEAEYIEAMHSEIRHAVQIQEQLGLDVLVHGEAERNDMVEYFAEQLDGYVFTRFGWVQSYGSRCVKPAVIYGDLSRPRAMTVEWIRYAQSLTDKVMKGMLTGPVTMLMWSFPREDVSREVQARQLALAIRDEVVDLEAAGIRIVQIDEAAFREGLPLRRNAWPHYLEWATEAFRLCASGVRDETQIHTHMCYSEFNDVIESIAAMDADVITIETSRSDMELLEAFEQFDYPNEIGPGVYDIHSPRVPSREEIVALLRKAARRIPAERLWVNPDCGLKTRAWPETEAALVNMVAAARELRGDLARG

SEQ ID NO: 31825 - protein, 424 aa, Pseudomonas aeruginosa
RPGVATRCHRAERRHHPFHSRWPDTVRQPAVPRGGRLLGGRAGRQAPSDLLRRGLPGLRRLRALLEGTGQRHAPARRVQAPAARWYAGLAGGHLFPGEECRRGGRRGAEDRRRRDPQPFRTAPAQRDQRRHTPVHGGHRVHPGRRDTRCQRKLPASLRLQPQVAQGPAPPHALLRRVLSGEPGFLGSAAARRILTRAFRAPQRRRRAGTYRSHLQPGQGQFGADNQGHQVRHRRYRAGQSQRGSTARRRAVVLHRGRDRADFHPRHRLPRPVRRPVGQDPVDGQHRRRPDFPAHPPDQGHREHRHHHPERRRTDQPAGPQRRHRGGSRRRHGARLRGGRRRGAATGGAHQRRHGGDQERGHRERQADPADQPQHADHRVQRPGEQQPDHHRGRHHAGDQQGRRARGAGGVEPVQVTSAQGSGGR

SEQ ID NO: 31826 - protein, 766 aa, Pseudomonas aeruginosa
RQAAGPQRLQDRIGAQRHRSRTGRSPLGRDRPMSSLPHSTGQALDRVDGPAKVTGQARYAAEYPAADLLHGSVVSSDVARGRVRGIDCAAALAVPGVVAVLHHLNRPPMAGDDEPYKDADAAEGEPFRPLFDDRVLYSGQPLALVLARSLELARYAGSLLRIDIEPEPHQTDLLAALDQAHEAPAELPAERGDFYTAYRAAPIRVEASYSTPIEHHNPMEPHASTVIVQPDGSLLVHDKTQGTQNSQAYLQKVFGLPADKVRVCAAYVGGAFGSGLRPQYQLALAVMAALQLRRSVRVVLTRQQMFTFGYRPRTLQRLQLGADAEGRLLALGHQATAQTSRFEDFTEHVVEWSGMLYRCENLSLAYRLVPLDVYTPLDMRAPGAALGLIGLECAMDELAVRLGMDPIALRRFNFAERNGNEDKPYSSKALLACYEEGARRFGWQARDPRPRSMSEGRQLLGWGMAGGVWEAMQSKASARARLEADGLLRVASATTDIGTGTYTVMTQIAADAAGMAPEEVRFQLGDSALPKAPLQGGSFTVSSVGSAVRLACLRLRQALVAHARARHPELAGTAEERFRICRGHLEAGDTRYALADLLQGLPEDALQVEVEAEPSARRKGYATATHSAVFVEVRIDEALGTLRVSRVVSAVAAGRVINPKTARSQILGGVVWGLGMALQEETQVDHALGRCMNHNLAEYHIPVNADIGDIEVIFVDEPDDIVNELGSKGVGEIGIVGVAAAVANAVYHATGRRLRDFPLTVDKLLG

SEQ ID NO: 31827 - protein, 181 aa, Pseudomonas aeruginosa
RAVFAWKHGCGKSSAGNPPTCRTRGTPHSLALRLIAAKRPTENHRVVQSLPKEISMKNAMALTLAGLLAAPSLGFAAAPDAVMVFARQGDKGSVSVGDKHFRTQAFKVRLVNAAKSEISLKNSCLVAQSAAGQSFRLDTVDEELTAETLKPGATVEGEAIFASEDDAVYGASLVRLSDRCK

SEQ ID NO: 31828 - protein, 434 aa, Pseudomonas aeruginosa
QSKLAKSIPRETPYTATFHLPNPSPIPPQPIPTDRLVNRLPQPVDPADRPMLRQCVPGVEREVVTEQVLFPAIKILSWHNDVGYGSEGRVRLLPFDAGVFDGHVLARVLALHLEGVAGGGAVDGELLVQGGAEEVGQVLVLLRQLVGRALLRGGDDAELDVVFAQLVRRDAVVAGVQRAVRGGGEGAQGDQQVAQFPAGGVPVGEEGQGFLAVGLGGEVLPVFGDVADEEHRLVEHDEVLLAVMAAAGQEFFAGHVEQLDGHAARVVLAVELRVGVAVGEAHPGVPAFARFGEHAATQGRVEVGAYLEFGLHAAVGLGVGIAQDAGVVAVLFDHADGVLDDRLGDAGFVRGDLLFRGHRAGEFPGVVEAADGPAAEADGQQQEEQAAEPFAEEQPGVGEECAHGVGVLGGVRWLWAFILLGRGVRHDCFSPSSG

SEQ ID NO: 31829 - protein, 486 aa, Pseudomonas aeruginosa
CRPGPWPRTVARGRVAADRRRSAGRSSAPVRRRSSRACAGRSGGRRCCRRWSGRCRSPRSAPCACATRDCVRGRRIPPVAPWAHGRRRSWLRIGRGPGRRVAGRCGRRGLPARSVVSVVAGFFQGVQVVQAYAGGVALLALQRLAVLVEDLQARADAEGLADIARHRLHGRAVPLHPVEFPDVPDLRIAHRGVGDAVVARVDGIAEDAVGDAPEGVGAAGAFLGGVEVAAGVVPGGAQEGVEYGLEVGAQLRLVLFVAFAEDFPGEAVELERVVVGGGHARAERLAEGAAAQGRHGGGDGVHGGAAVDAQRLALVAQFAGVAGGAGDVQVAGAGLLVAVLAEAHRQVAGVEVAGLLLRIDEEAEAGEVFGGGEGFFGEGQFEGGEPVVVQALHQGALGRVVEALAGLVLPLRQVAYLARRLVVGEVGIGEVVDHHPDDRQHDHADNQQSLFHGAHQERPCRPFLGTVMPRRWHIGKLLSAFLTRFS

SEQ ID NO: 31830 - protein, 971 aa, Pseudomonas aeruginosa
VRTSPRRRAGRCGSFRVEQDHRRAQLAAAEAAHLVELGVAYRDVLAIQRLAVLAVVDVGIVEVDEVLVVVGDQHPVRGLGAGQAVAADQHQRLAAPGQLAWDVEPGRAFLLDARGVQFLAEVLVDQAHHRLLVFVAYAVEEQRAAGGQYQLDPEAAPPGGQRQALGATAAVPGGHVDGGRLAPQAQFLAAGQLALRLQRAHGHQQAGRAAGEIGGLPVEGHVAALFVAGVADAFLEAQRFAVVLVVVAHGGEGTVAVALVEGDGATVVRAHFQAHVGAVVVPRGLLGGFQQLLAEADAAGARVDGDGVEAGQRGAFVEQHQGVAEHAAVALGYRQAGVGAGEHPLEVAAGQAIVVEAAVFQLDQGGQVVHTGRAEGQVHSGLHGRGRELPRGRAVMGAVRFGLLAGAIERFRKGFPPSIGRDACAGKPVPNAPWFRCHPGRCREQAVHHRGTQGRLDVLLPQRGCGHRPGIPGTAHRRRHWQAGPGDQPVPALQVPAPWLLLLAARRGARAQGDPLGADHQRAGQEVAVQPGPGRSGSHPGQGPGRAPLRQHRWFHPDPVFRPYRYRAAAGPGATTVRGVSLPVAAGGVQAQPHLAHRGHQARRHPQAARGPGRPLRQRPGQLQPADLAQAAFAQAVPLRSGDPPRPRRGVPAFRRQGAEKLRAGRPQPRHRRRPDRAQGLFADRRVRRAVHPRDHQCRRPHLPFRQEGRERRVGGDGRPGVDPALHQQGVPGRPAAQPQAGHAGHGDSLQGEPAGTGEGRRAPGLPAGAEDSRRQLLARGDQGGGPGAVAGSQRRAFRALGADPCPGVLLYRVRLAYRRAQPQADLRLPVLHVQGPLADLRPQPGRRGGQRRFPHHARARGAAQGGGAGGEDRQPDRRRPLRGGPEAGRRQGGGDRGERQPEHRLRGGGCLPRRRPLQAGPGGVRPAPGSQASRLRLIRRFRHWRYKQRFTFARQKIARFSFQSANMPFL

SEQ ID NO: 31831 - protein, 142 aa, Pseudomonas aeruginosa
PAGRGGRAGAGGDPCRPGGGDRCRDVPRGPLLPAQRPAGRHRAVARTERGPAAAGPAFLPALQPGDRPPPAPLQRGRAGGDGDARLAGQCPRTGQPGTSRVGPGRGKADRGPGPRPGMRARRRPAVVQPGGLQALRRAPGDV

SEQ ID NO: 31832 - protein, 373 aa, Pseudomonas aeruginosa
RTRIQPIPTGSRQLLVAIDRICQIDAYSPNANVCVWIISWKSLNTTIRKAGGYTMKRVASRRLLAAVVLTACSSFLPLSAVHAETPEKPRIALVMKSLANEFFLTMEDGAKAYQKEHADRFELVSNGIKDETDTSSQIRIVEQMIVSGVDALVIAPADSKALVPVVKKALDAGIVVVNIDNRFDPQVLQAKKIGVPFVGPDNRKGARLVGEYLAKRLKAGDEVGIIEGVSTTTNAQQRTAGFRDAMDAAGMKIVSLQSGNWEIEKGNAVASAMLNEHPDLKALLAGNDSMALGAVSAVRAAGRAGQVKVVGYDNIQAIKPMLKDGRVLATADQFAAKQAVFGIQTALKLLAGQTPEHEKDGVVETPVELVTAP

SEQ ID NO: 31833 - protein, 517 aa, Pseudomonas aeruginosa
AVRWSLPMSSDALPLLSIRGVGKTYAQPVLAEIDLQLFGGEVLALTGENGAGKSTLSKIVGGLERPGAGSLELLGRPYAPASRREAEALGVRMVMQELNLLPTLSVAENLFLHDLPRRAGWIDRRRLRAAAREAMAQVGLEAIDPDTLVGDLGIGHQQMVEIARNLIGDCRLLILDEPTAMLTAREVDMLFEQVERLRERGVAIVYISHRLEELARISQRIAVLRDGRLVCVEPIERYDADQLVTLMVGRELGERFDLGPRQTGAPLLRVERLSRRGKVHEVSFEVRAGEIFGISGLIGSGRTELLRLIYGADRADGGQVLLGDPPQRLSLRSPADSVRQGVALITEDRKGEGLLLDQSISANLALGNLPALARHGVIDRRREEALARRQVEALRVRCADTAQAVGELSGGNQQKVVIGRWLERDCQVLLFDEPTRGIDVGAKFDIYALLAELTRRGKALVVVSSDLRELMLICDRIGVLSAGRMVDTFERDAWTQDALLAAAFAGYKKRDALLATS

SEQ ID NO: 31834 - protein, 425 aa, Pseudomonas aeruginosa
PPWASRSACSARSPRNCCCNASPSARSRCSGGWWRRRWSCANPPRRRWCGSEPGAGGALARERLEQGRNDASESTGGGQPEHGPGGARAAPATGRRDPRRAVLHHHSRRQGRQPGGRRGASRRWGGDDRLPWRRCLRRPAVPRAAGRGHRLPGRRAGGRGVQRGGADRGRRQQPERHRHRRRRQRPPVAGRAGAPRTLAGAGAGGGLPAGKPAGDGWPCAAPGPCAGQDGDPQPGAGHPRRAGGLAATGGLPGPQRDRKRTALPPAGGLPGERRACRRAPARNGRRQGDRHPRRPGRPAGGRGAGRAFPGGAGQGAGYHGGRRHLRRWLRRGPCARPRRGGGDPFRPGRRGDLGDPPRRADLDPLARGSRAGARWRGLRGTVPLLPADNACGVIRPAQLGEDRSQAHASLRGVRHAQARTVAPQK

SEQ ID NO: 31835 - protein, 273 aa, Pseudomonas aeruginosa
STGAPPARCEAREQARGAARAAPFFVWPPRVARMQRETGSERVDVDMEKPGMISRWYDDKGFGFILPKTGGEEVFLHISAFRGDRRPRQGDQVWFLASQDAQGRLRAERARLDALTIDPPTVRRGAQAPVTRAQARPAPTPPSALQRPLAKLLVLLILCVLPAAGAWRMYLDGQALWPLLAYPLASLLAFALYWRDKRSAARGDWRTPEVRLHLFELLGGWPGALVAQQVFRHKTRKLSFQLVFWGIVLLHQLFWLDSLLGGRLSAALLQRIG

SEQ ID NO: 31836 - protein, 100 aa, Pseudomonas aeruginosa
IGRTITSTRNRPVSACYCRNCGARATRLVENGICEACKRRSDINPKNVLIAAALIVYIGVNVAAYIKDHPPRELTAEQREKIAEGQRLATRAAMMAGYVD

SEQ ID NO: 31837 - protein, 145 aa, Pseudomonas aeruginosa
KSSCSIVLIRSAERGKKRCRRRQPGRGVDDAIGAARRHVPRSAGRTSGRPLGPAQAATCAGLPSRRSTRLQAARVATEGINQARPCSANGRCSSHCGKSWPRPAAFRASSTPNARETSITGARMRVAECQRPMQKLSATSTMHGG

SEQ ID NO: 31838 - protein, 134 aa, Pseudomonas aeruginosa
QTAASRPPAYLPIGWLRASTEPPTLARAITVITGSPTAVIRKPSAASHTWGPDCKPTMGGKMMLPAPTNRAKVIKPSARMSRPFKAFMLERYRAARGNSQKGFPGGRGNGTHLDGTSRGGGRRPCGNRAVSLAC

SEQ ID NO: 31839 - protein, 571 aa, Pseudomonas aeruginosa
  UNSURE (293),(297): Identity of amino acid at the above locations are unknown.
RSVPMSKARAVRPELLTLLVSLAFLLFYNLPLWQRLLAITPAGWQGLGMMLAVGLMIAAIFNLALTLLAFRWLLKPALTLLILAAAGTTYFMTQYGVLMDVGMLRNVMQTNPAEVADLLSPKLAVYLALLGALPVWLLWRTPVRYRPWPRELLSKLLVALACLALLAGVALANYQGLSSLFRNNKELRLQVTPSNLVGAAIGYAKGQAQAASQPLRPIAVDARRAALWQGHARKSLTVLVVGESARAQNFGLNGYARETNPRLKAEEGLINFSNVHSCGTETAVSVPCMFSNXGRAXYSDARARTQEGLLDVLQRAGLRVLWRDNQSGCKGTCDRVAFQDLSESKDPALCAGGECHDEILLRDLQAFIDGLQQDTVLVLHQMGSHGPAYFKRYPREYEKFTPVCASNDFSACSRDSIINGYDNTLLYTDHVLASLIDLLRKNEERIDTGMLYLSDHGESLGEYNLYLHGTPYLLAPDQQKHVGMLAWFSPGYQSAFGLDSGCLRQRSNEELSQDNLFHSMLGLLEVRTGAYDPGLDLFAPCRAPEVLQALKADGGRALYSEEASGQEPPAS

SEQ ID NO: 31840 - protein, 529 aa, Pseudomonas aeruginosa
AATTCSRPRPGCWRRAAAGGCFPVGAEASHAVTRRQPCRRHCGVRSKAALLRWRSRRDQGCATAGGALPAPCAAAPTPTMKKRRSRPKEAYGRAFPVSIIGSATTGPVVSPRGVRHEQEQHRRSPNPAADPGLAGCPGRPATGRRRYPAVRQGRDHIFHRRLLQRLLRQQRRRPPGRDLRSPPVAGEDGIPAELHRLQLRQEGRRAEPRWSRFLLGDHQRQRDRRHRYRHRRPSVLRHGRRRLGRGADRQGLRPVLALEHLPRRTAGRFRQPQRHPRPGGRQGRLLRQHRHRLSVSVPHLADHLPQQQPAARPAHRRGHPRPDRLQPDRQRCQRRPRRQGLPGQPALRERGQLPVRPGRGAGLQLDQRRLPDFEEHQRQRRQRDFQGGRLWLAGEDGRLLRDRFGVHRQGHQSLLHQQRRRSRAARGGQPRRIAAGLVFMGQEPPGAVLRQDRRRRQRPGFRGRLRESRHRLFPHDQRQPQAGRRAEPLPDRRARRCRARRGHRHRGARRRTELVIPKLSKDPAATQVG

SEQ ID NO: 31841 - protein, 178 aa, Pseudomonas aeruginosa
PPAKGYAWTSWPAGRWSAATSNCSRESSATCFPTPSAIPREGACCWVAAGIGSACRSRSGTPGWASPPTSSARFSRNSSAASHSVVTKTAGSAWDWRSSTRSPACSATGSGSARCRARAHASPSRYRWPAMPRAVAPSRWPARTTCASACVVRGCGCWTTMRRSAQACARCSKPGAAG

SEQ ID NO: 31842 - protein, 206 aa, Pseudomonas aeruginosa
RPRSATCWSAKPRSDSGVFARRAAQARGEDQGDPAEHRQGRRRQSRGERLAEQQGAAEGGEHRHAELHRGALDRRQPRQCAVPDGVAEAGGEGAGKQGIGQPGAVQPQLPVECQEQQGGEGKGTQEVARADRQRIAAAAAEQGIEAPGEAGQEHQQGTAQRRRAGSGEQQEQQAAQGQQETEQRLSAQPFAAQQAGQQQGDLYRAE

SEQ ID NO: 31843 - protein, 160 aa, Pseudomonas aeruginosa
RYRPVPDGHPHPTVVAALHGRRRAAGAGTPGALLPGAGRQLPRAAARSTAAGPATPVAGRGAARLRGGLAGRPGHRLRAAPGRSAAAPGCGGRDPSLPPVAGGAEQRRPACRRQPRADPPAMPWRLSLPERTRRRSRLRGGPGTRLRPGLDAPARALPGR

SEQ ID NO: 31844 - protein, 425 aa, Pseudomonas aeruginosa
RTGPGAPGAGCRCPRLRDQASGADGAAGGDTASARRPALSGAAPGHAPGLPVVGRAGRGSVARADPSRVRDLPPARAWPGPARGGRAPGGKRQDRVQPCQPAQAEVAGEYPGGTGAPGHRQRRAAAGPAAAARRGGSRQPRLGGPSLLSGASLPARGAILATLHVAALEVAEAHLAAAQVGIFQVGLGQLDFLQVGVAQVGALEIGAGQPGHLQVGGAQRGLVQAAAAETGELQVGGGEVGALPLGALGEQAPGLDRHRPGAGEVGPAQVGLLQAGTGEVGTTQVGFFQVGQVEPGVTQVGAGEIGAGQVDAAEVEVAQVGAAQVGLGAARAGLQAAAGDDADVVDVVGGLGQAGAEQGGAEEEGLHRDTPQAGKAAPRRARRGDQRLAVRLSQLGSLNTQKEPPWATGRVRSAMSPPHSGTAPP

SEQ ID NO: 31845 - protein, 298 aa, Pseudomonas aeruginosa
PPRQWTPRDSSRWARNGATPTPTASPTPSTTSPSRSAPPPTTRTARAATAWKPSPAASPRTCACWRPAPRATNGSRSGSSTARCAMARCTCRRWPTSSARKASGRSAAIWKACTSTSDAPDPSPPTAAPLHESAAPRRNDHTGELRHDLRSARNPRCRRYLQASLRQLHRRRVRASGQGPVLHQHLAGERPADRRVPPFHRRGHRQGPRRRPRRRRRLGPYLGAGAFEHPAEDRRPHRAEPGTARRHRDLGQRQGRARDPQRRHPPGRRPLPLLRRLHPRPGRLRRRDQRQHRGLPHP

SEQ ID NO: 31846 - protein, 415 aa, Pseudomonas aeruginosa
AAGRGRADHPVELPAADGRLEAGPGAGRRQLRGAQAGRADPAGHLRAAGTHRRPAAAGRAQRRPGLRQGGRRGPGHQQAHRQDRLHRFHPGRLAHPQVRGGEHHSLHRRAGRQEPEHLFRRHHAGRAGVHREGRRGPGAGLLQPGRGVHLPVPRAGPGVDLPGIHGRGAEKGQGDQARRPAGHRDHGRRPGFPAAVREDPLLPRHRPAGRRRAARRRQRREARRQPGQRLLHPADPAQGAQRHARVPGGNLRPGGRSHHLQGRSRGPGHRQRHRVRPRRRPLDPRHQPRLPHGPRDQGRSRVDQLLPPVPGPRRVRRLQEVRRRSRDAQDDARPLPADQEPAGELRHQPAGLLLVGPRTGRDRSFPERSRRLVKHAAEADGGAPSTSSPGRLQSGWHSYCLRSPRTAHHRENRGR

SEQ ID NO: 31847 - protein, 486 aa, Pseudomonas aeruginosa
GEKPMSLEQTGHAPATSGVDFESVDADYFQHRQLKKGAAGWVLLVGLGVAYVISGDYAGWNFGLAQGGWGGMFLATLLMATMYLCMCFSLAELSSMIPTAGGGNGFARSAFGPWGGFLTGTAILIEYAIAPAAIACFIGAYCESLFGVGGWLIYLVFYIVFIGIHILGAGEALKLMFVITAVAAIALGVFIVAMVPHFDSANLFNIPQTAATGASSFLPFGYVGVWAAIPYAIWFFLAVEGVPLAAEETKNPKRDLPRGLIGAMLVLLAFAALILVVGPGAAGAKELMGSGNPLVEALESAYKGSTWMSQFVNLVGLAGLIASFFSIIYAYSRQIFALSRAGYLPRSLSLTNRKKAPVLALVVPGVIGFGLSLTGQGDLLILVAVFGATISYVLMMAAHITLRIRRPDMQRPYRTPGGILTSGVSLALACVAVVAGFLVDPRVVVGAVAIYAVLIGYFALYSRHHLVSGTPEEEFAAIQAAEQDLR

SEQ ID NO: 31848 - protein, 442 aa, Pseudomonas aeruginosa
RRRRNLPLRQPQGRDGQGQPRALRRFPRRRRGEQRRRAGRRADGPGRHPAQTLPRRGADSLRGRRGHPPDHRHPPARRLRPGVPSHRRRLPRLAARRRRRRGQPARPGSGPDAGNGSGGIEDHACPGPGPGGAEDPRGHPLPQHPRPSRPALHPPATKPPDRRPGRNRREHPRRPAVRQWRRDARDQSCHRQHGLDLRPAGDARRDHPALRDSYPGLRADPRHQLHRGDQPRRAAGPGVPVDRRHRGGQCQLRHQPEDPPGRLRGRAQPEARHPRQQPDVLRDRPGQRALGQRPPRRRPADLRDPRLCGGSSLQAVPGEHRGRLHRSRVPVQRQADHPRRPGRPLLRQAARRADGLRHLLHQPCRGRPGRHGHAPDPAGRRRDQLHHGHSRLRRRDAQLPDHLLPRRPLCAPDAGPEAGAGIRGLVAADGNLHPGRRAHPLR

SEQ ID NO: 31849 - protein, 156 aa, Pseudomonas aeruginosa
PPRGSPWAAPAPACRPARNWTSSTPTPRRATPCTCPSTMRPSATACASAAATACCCTAPPPTATSTCNARTSAGASTRPRCNACANTPPATTGRSTWPSWSPTASPRWPCSVTPCPSSNAWRNRRWPKAGRCRRWSWWNRDGWRWPTRSVNCCGRR

SEQ ID NO: 31850 - protein, 315 aa, Pseudomonas aeruginosa
AEDKGTAPPNRSLRAEASMGSRTWHWPGVLLGLLLATAGAQADTLRVATLDWAPYVGPDLPGKGLASRILDEALALDGHRAELVFLPWQRALKEAAEGRFDALMPAYLSPERRELFHATIPLLDSQLGFFRQRERLLPVNPAHLESLRPYRIGVVRGYVNREDFDADRSLTKDAVTNDWQNLEKLLRGRIDLAVVDRYTGYHLLARNVPALKDRLVFIEPPLEVKPLYVLVPKRHARGAALAASLDRNLRLMRRSGRLEQLIAEAHLERSGQTRTLAVDPLTGQADQQRSPGQEQDQGQHAPLQPAWREDPLGMR

SEQ ID NO: 31851 - protein, 337 aa, Pseudomonas aeruginosa
VAPGGPARIAVPAAGALAPNPAGCASASAAERTTGRHDDATGATTILAAGSPHGSAAMPIRAARTLRRHRPPRAAATPRVLARRRRGIAARAGRTRKLPARSSHPRSRRGTPRPALASRYAVAPPGRARAPPARPAPPPPAHAATAAARPPGAPWPAPHNALRGRAGRPLRAAAGAPATRARRPPGSGCAGPAPAPRCYPAAGRSLPGAAGCPGDNAAGRRRRTGESARLRHGPAATPPPARARPARLRGAGDRAACSAKPGPAAPPALPANPRGYRRSRRTGRRDGLRWPAPRWRNRVPRAAPGETPEPVRGEARAIRREPARPAPGGRARRPGRD

SEQ ID NO: 31852 - protein, 369 aa, Pseudomonas aeruginosa
RNTPTCRPCCWNRSSTSSRTTRISRKASGSRSKAGATPTPPAPRSPRPWPRSRSKRASPKRSPAAAGLFHSPSPTAKVGLATPLRSVDRRHALQPISVAVDGQQLPTALGGQAKLVAQAIDVGIQRPRGQHFLVGPEALVEIFPRQRPSQVGEQAAGQAVFAFGQADRRAGPGHGQLGIVEAEVVESLHLMLRGTRSPVATQHGGYPRLQFVGSERLADIVVGAAVQRLHDVLFGVTAGQHDRRRRRIQMLAAPAQQLQAAEVRQLPVEDQQVEGFPLELLEQVLATGETVHRPGLFALRGYLLQGLLDPVQFGRLVVQYRDTHKSWSCSIGLTPLFRSRNGELRTNLKNCDESLWSRPALDSLIPNSH

SEQ ID NO: 31853 - protein, 312 aa, Pseudomonas aeruginosa
AKEQMDCSDTGMCKPAPAGRGTRPLEPQSGVGNGRSPQATKPIPPGLASTHGCVISPSLFESSPPAIRTPRSASHPGSEKDLIMKQYGAEFFGTFWLVLGGCGSAVLAAGVPELGIGYLGVALAFGLSVLTMAYAIGPISGAHLNPAVSVGLWVGGRFPASQLLPYVVAQVLGGLAAGGVLYLIASGKAGFDLAAGFASNGYGEHSPGGYSLQAALVSEVVLTGMFLLIILGATSKRAPQGFAPIAIGLTLTLIHLISIPVTNTSVNPARSTAVALYVGDWAVSQLWLFWVAPILGAVLGALAYRLIGDKND

SEQ ID NO: 31854 - protein, 347 aa, Pseudomonas aeruginosa
PDRQRYLTRRPVKPMTALALTSRSLFPACAALALGGLLTLLAGSVAAAPAKTKRPPFIEQGETCLPQPLPASVLYLAGDAWKLDAKGNQTPLEEGMDIDELEGVKTSPTAFVSLLLGDGSRIVLPSSSEVTLHLDEDTGIPQIALRAGQVESYVLKRKSDHDRFQVLTPVGVLGVRGTHFRARTEDGQALTEVLDGRVAVNRELTSDDLPLNGRRPARKAAQAEPDEDVLVDARRGLKVKPQGKLTPVDLLPAPQLRGQGGEHGESPVWKLYLAPLHGAKRYRAQVASDPDFLRIQQERFSSTPEVSFSGLKAAFYHVRLSAFDNDGLEGETSVYDILYYPRGGSAR

SEQ ID NO: 31855 - protein, 772 aa, Pseudomonas aeruginosa
GTGASPMKALDRQDEPSQAQRLFRGLVREWLLVSLLLLPLTALLSLSSGLPLNNLLYDRLRNLAPLAVDPRILVVAIDDRSLESLGRWPWPRSVHAELLDRLAAAGARSVLLDVIFSEPSSNPDSDRQLARSLCRAGNVLLPLLRESVPRYGEPPREIPPTAPLAGCAAGIGHINVEADSDGTVRSVYLREGPLGQPRPLLAWQAFADAGAMPMPGLDDMRNLPGWQRDHAIRIPFIGADAGFPSVPYVSVLRGEVPDSLLRDRLVLVGATAPGLGDRYVTPLSASLGTTPGVEIQANILNGLLQQRTAVDLQPWLAALLSAASVALLLGLMLFRSRHALLLTLACAALALGLSWALLLNGWWWSPLASLVGLLLAYLIWSWRRLNAVLAYFGWELARLDREPKVLPERASPPRAGNDPLQNRIAALEQAVSRTRDSRRFMADGLECLPVATLICDPQGQILLANRKARDLFGGELRGAELRQRLAELGHPSLAGGARPTLETLEAIEFRDHRERDLRLDLARLLPVESETAIGWLVSLIDLSAERDAERQRATLLRFLSHDLRAPHSAILALLDVRPAEDEAGQQVYRQIEQQVRRALGLTDAFVQLAKAESDAYRFEACMFTMLAMDAADQLWPLAQQKDIDLRRDWDDEQEPMVWADPGLLTRALFNLLENAVKYSPAGTVVSLSIRLEGDWLSCRIVDQGKGIAAAELPRLFSQYQRFASAEGSAGLGLGLAMVKTVIDRHGGRIGCQSQVGQGTTFEIRLPLLKGEE

SEQ ID NO: 31856 - protein, 471 aa, Pseudomonas aeruginosa
PARPAQLRPPRRGSAGPLCTAEPWQCPIVRDRSPAILRRRGPCRALRPAGAAHRPEWRSHLLWPGGHQPDRRPPGDPVLLAGRRAASGIRSQPPGPGTRTAGTHGSRPDELAADDRAGAHRRAAGQQALGDDGQALPTVRHPHPGARFDGNPRRSLGVDAGAPQAIVRTDPIRHRPVRPARRQAAGLRRPSESRRCRRREKLRPGPVAALLGRPVAAGYPAGGCLVRHDQAKRRTSPGAQSDLATPPRRHVPPRQRADHRPGKPQPRQRRPARTSRRSLDALHSVAAQLGAQHAAVAGTLPPILDGAAQRHPGPDRGTLRAGRQGRGAGDECLPCGPREARRRPERQREHPCAVGRRYGPAEQSALAPGTARPQRAAGMGGQRPVRRQCPRLPLRFGRADRPTLARPYEAPVHPRGSAPPRGRAARPGTAQRAAAKPQRHRQEPAHLAAIDGRRRPGGDSGNGSDAAPLHR

SEQ ID NO: 31857 - protein, 97 aa, Pseudomonas aeruginosa; identical to SEQ ID NO: 25885

SEQ ID NO: 31858 - protein, 221 aa, Pseudomonas aeruginosa
IMLFEELSNMSPRDLILRTRESLRDTYESLFGNTQFDEFILAVRDDIKKGKITETVLNNKWLEHIAVDQISPSYPFLYACVLNELAQQALDAGNHNQSWPLIAHASASAEGAATHTFYNTVINTTEALNHNRAMAGANARNEKFQMVKDYALTLMTEKRPKHGWNDFMHAAESIKSELVNFIILEKVSLSQDLIVKTLQRWLKKDEHFRSAVTEIIPTFKL

SEQ ID NO: 31859 - protein, 283 aa, Pseudomonas aeruginosa
RRLFPCMESSRYDVFTTTAFTTHFYKKSCLWHLKSAAPPLIQSSPSTTNKGIIVETLVKTALAATIFLATHAYANGHPEFDQYKTSDVILCESTGRVMYGFPLTLCLEESRPGKHVVRYQNRETGEITMKEEETFEYIRCSKAQDKCTDRDGNYRGKFSAPRDTYYAIFKDFYVYPGNDGKDYAYKTGTGPLFGGAAAASVAAQPAARLTATPTATGTYDVWCDPQGDSCEITIDGGDDMVSRERLPVYVPMASDTNNCTLEFCYNSSQDVIGLNPDYHLWKK

SEQ ID NO: 31860 - protein, 337 aa, Pseudomonas aeruginosa
ALSTGVLPTRFGSIRPSVRPVLPFQRPRTQRATCACLFLLPFGLGKLRPETGWMAASEKTIIIERIFETLYDETTKEFSRTLVTSEDVQEAKRYCAEHHGTKMKLDGNPYNFMKDIVRGKSASRIWPQRLKDLGIGGVQRTGDGAIFEFVHGIEGALDSLDEDFRPSESTPNFPVQSLSLPLASKALGRTDESWLLQVAVNLRVIESHFANSKHSQIEALELTHLQMDIKLRKVQIDALFRALHTTPDGGPSDALITVEAKQGNQRILTEQIGRQVIAAFESTETELVIPVAIAAVKNKGIYVVEFTAVHRQELDKFSAPQFHRDAMFILQPKVKGI

SEQ ID NO: 31861 - protein, 201 aa, Pseudomonas aeruginosa
GARLSNWWSSVPSSGPLIRPKPCTATRVPAAAPCSSARTALALSTETAGNTQPMPAAATKKASQSSGGESAKHTAAKPMAATSPPTRISRGGGQSRRRTRSWARISATPTAVRAMPATRAASAESRRSRSRAKKPTVICATVTLNIATKPTASGRRRRRSPIARAAPRFGWRRSSRGSQRQSASRATRGSAPVTSNGRTSP

SEQ ID NO: 31862 - protein, 671 aa, Pseudomonas aeruginosa
CSISSWKISGNPVRQSISRKIVEIRLVHLCTRYQVRRVFAVIGWSSAVSGYGGADSEVRREGKGKGARRADRQVAVGCGPVVLAQCVLQVGARHQRLAGDLEGVGGAEVDAVPVRHGEGVGAVHIGRAGVDPAAVEGQSVDERGVPADPQVGLAAGHAGRVLAFAGRVAGLVLLGLDVGGAGHHPHAVQRFAIEAQLHAAVALLAVGAEDVAGVGIGVRFPDLEQRQGGGEAAQVVLGADLVLLGLVWRQHLAGVGRGHRRRLALAEALDVVGVQRQVLQRLDQHAGHRRPHVPLVVAGARAAGLVVVARLDLLAAHAQGDLHAIIEERQPVGQRHAAEVGFIGLRNAPVEAGEVRQRRMRRGLVEVARLHPGEGIDHAQPFVQAVGAERPVVAERAGVEVAAQADLGGIGAAVAALACQAVDDIALVADEDAVGGDGFVVALAAADAGERRQVVGEVVLAAVDHGVILLVQVGIAQAEACLRVRGMGDVGGSRAGQQRAHHAFQAFLLVQQVAGQAQALATEVQAQGEHGKLAALMVDGGIAVAVDAVEAHAEGVVLAEAPADVEVSAELAALGPIDADAGQRLVVGALGHQVDGAADAAAGGNPAEQGVWSLEHFHALGEFDRYPPERQQAIETVEGDVGVLHAEAANRVAVHQVAAPADHPHRRIVGL

SEQ ID NO: 31863 - protein, 263 aa, Pseudomonas aeruginosa
QVGDAARLLLLDGPGGVAGDAEWRVHHVGVAQHAQARATGYLAAGVLGGQGLGTGGLGGDQRGLQFQRAIGGCRHQGVAAVAALLQLQAAAQQQAVQRLDRRVAAAQGGAAATLGERRVERQGHPVVAGEGRQGATERAGGDVIAARRAGGGRLGGKQGGGRSGEGEGHGGGVDGQGQRTGAKRAYGHVQGSSWSLRTLGRGGFLYLPAEKEKGLRSRRLFFCGARYVDGNACSGATADGLPGWTRGGGCHGDGGRAVTPAPG

SEQ ID NO: 31864 - protein, 171 aa, Pseudomonas aeruginosa
RHNGRREWLWARARRASRKASAQRSARRSGALTPSELSRASCSVEARPAWCSKMISWPCARTSRRESWPRKRPIGSVASPSELATETTASSRSSPGSSSSSRSSAWFPGIAVRAAGRGAIPNPGAGGVRFRRAAVRSLCRALPSGGAGDCSPAAARPGLSAGSSGRKECRC

SEQ ID NO: 31865 - protein, 718 aa, Pseudomonas aeruginosa
PITRVQTSQRWRWPSGNWLGFIGGTPCWWMKGTTGDSTAAAAATALGRGALQQLLVALRAELVLAGQVAVPRADREGGGDGQVRQAEATEGGAHQGLAGFGGGNPLGHVEMQHGAAGVLALQGVLQLQRLERVVGEAHRQLRGVGVVGCLRRAGLEDARIALAVLAGEAIGGALGGRGFQVVEVPAVLLETHQPRAHVIEQGQGHLAPGFAVQSLAVVAEVAHHLVQAVHADGGEMVAQGTQVASGVGIEAGIHVLLDHLALQLQAGEGEFEQVVELAVEAGGVATVAIAQARAVDRHHAQRAGLLRRAEQAVATLEQFAHVQLQAAAHRAHLVGLHVRVEEVLEVGQAVARGHLEQARGVVAVPGEVVGDVVGRDREGEHPAMGVAGLHHLDVGAVDQVHLGLQLAVGEGHLLAADARHLVAQVVRADPVEGQVGEGRLGAPARRHVEVVDELLEGLAHAGVVEAVLAHVGRQVGIEGAEGLGPGPFVLQGAEEVDHLPQGAAQVLRRTGLDPPRHAVQAFVQQGAQRPAGAIAGEHVEVVDMQVGVAVGGGDVGIVDLIQPVVRGDLAGYVEDQPAEGIALVGVGAHPPILAGKVFVHRRGDVHQGLALAAQPAVAFAVDHVGARRGVVAGLHQHPFDQVLDPFDIQAGAFRQAFHHAFGERLRLLRVELAGGLAGGGDGAFDLAGIERDFTSVALEQGGRPGSLPGLGHFNFSTT

SEQ ID NO: 31866 - protein, 478 aa, Pseudomonas aeruginosa
  UNSURE (418): Identity of amino acid at the above locations are unknown.
LINTHNSYLPTMTPHSSPHRLPPLRLARAVPFLYLLPCLALAAPVDLEPTVVSATTTERKLRDAPASVSLIAAEDLRRRPVRDLQEALRGSESLQFNGVGMSRRGISVRGMSSEHTLVLVDGQRISTSSGAIAHSDFDLGWGPVESIERIEVVRGPMSSLYGSEALGGVVNVITRRATDTWMGSGLLDGGVREDGLGGQSHQLGAYLAGPLVPGKLGLALNGESRRQQETPDADERRLSELEGGNADSGGLNLSWTPDDAQRIDLGHQRGRERRWRNSETGGPRSRYYESRDVIERERWSLAHNGQWDWGSSQLRTYRNRLERHNTRSDGQPPSNPQRLTDSVVDGHLSVPAFERHLFTLGGEWRKEELEDRSVNTAGDASARHKALFLQDEIAFGPDWSLTLGSRFDKHEAFGWESXPRLYLLHHLSDALTLRAGVCRGYNAPSLKQLSPEYAAVGGGGRFTIYGNPDLRPETNTSY

SEQ ID NO: 31867 - protein, 185 aa, Pseudomonas aeruginosa
  UNSURE (6): Identity of amino acid at the above locations are unknown.
LGADYXSQCWSLKGTVFYNDVRDLIQTVCVARCGVRGGEIRNYENVDRARIRGLELGGGVDLPADLRWELNYTYLDARNRTAGQRLGDRSRHLANSQLRWSPNARFSAQLRTEYVGSQVAYSSNVGYALPAYSLWHLELSQKLSENLTLRGGIENLGDQRLADDDTHFTYAEPGRTFHLGLVASF

SEQ ID NO: 31868 - protein, 257 aa, Pseudomonas aeruginosa
TTTWAGARQRCARISRRSSACSTTTCTDWPARRCRWGCTPSVSPPRRSCAWAPSCSSSASPTTARSVSTPTNCSPPISGRCGKVVPTARCNATCATVARSPRWPIRACASSCCAPANWTASSPTPANWRRCSPASPGASSRPGRAAIRSAIRRYPAGATCSPSRPTRYRPAPPTKPAPRPSANCWKATAPSTRAGRRKSSPSASGRRKPCATWASSKARRCTPSACARAGTPVAACWRWTSCRRRNWGVHGWTWCYR

SEQ ID NO: 31869 - protein, 257 aa, Pseudomonas aeruginosa
RVYRRRSSRAPRRSTACSPPTTRSSTSAACRWRYATSTAPARRCTSPTCASASRAPRPPRSSSPASCAGATSARSGSPRCSARATPAAWKCSTWPTTCGAGRRRIAPWSAPTSGRRCTTPSSWTAASWVSPSGSKRTIRPPRRRSSRAWPRPSARATGTPASRPAANWPSAGGNWRPPAPARSARRPPVNSSNGWPAVSARPRRRQRARPRPVPAKRSAAASSKKSRRRRPASRSRGSGWPPPCCSRCSPPAPSGNP

SEQ ID NO: 31870 - protein, 276 aa, Pseudomonas aeruginosa
SIVVRWKIAHEWSGNQPLRTHPPVPAAGAAVDPRRAGLRLRRPRRLRHGSLAAPSRALPLAPGGLAGAAWRQQRRPRTVDHAAPGMAADHLAQRADARPGGDHDPHGTGTAGADPQRRPGDRREPGGGVFRGDPGPGRRQHHLLHPYRASPLAAPGTARRRTRAGGRLMRFLEHDEADDPILSMVNLIDLFLVVIGILLIVIVQNPLNPFSQDKVVVVENPGEADMRMLVKDGKELKRYQASGEIGEGQGSRAGVTYRLADGRMIYVPESGGEAGK

SEQ ID NO: 31871 - protein, 71 aa, Pseudomonas aeruginosa
PTCGWARARAPSSTGSTCWTACCRSTARSCAASPARAWSGCRSTSRSWSSTCRRHGRTPSSAPTTCYRANR

SEQ ID NO: 31872 - protein, 215 aa, Pseudomonas aeruginosa
QGAGAGVVHGKIPRVAQRLPWRQVLAVGVLVAAGPDEIVGLQRAQEEVRVAMQYRHLPPVARQDPRVAGREGRQGRFEVIHRTCPPASAAPRAARHSPAWNSPAGRRGSPRPRSRRHRGSHRCCRSPNPAGWGRTVSAGWRRRGGGLPPSPPPARRGSAGNPLRPRPVRPARRDRLPCASSWKWVSGYDGARSERGQSGRSDHSADRRWHGSQPG

SEQ ID NO: 31873 - protein, 452 aa, Pseudomonas aeruginosa
DGYLRFSTPSRWTGAIKESCAMLFGRKSRAVESAAKDEDLAWRLDAIGQNVATIRFTPDGQILSANPLFLAVVGYSADELVGKHHRIFCDEDFQASAAYVRFWKELASGTPQRGVFKRLRRDGTPVWLEATYFPVKNAEGAVVEVLKIAADVTRNHSELLLLNAINDAIRQSMAVIEFTPDGEILDANENFLRLFGYSLKSLKGQHHRMLCFDEFYRENPDFWARLRHGEFSRGHFERRSAAGERVHIEATYNPVKDSSGRIIKVIKFAIDVTEQVNRNEEVRRAAELSFSTAEETAQISTRGIDSLDQSVALSAKTLSMVNTAVGLISQLTHQTKDIENIVTTIQSVAEQTNLLALNAAIEAARAGDMGRGFAVVADEVRQLAARTSGATVEIKNVVTENVKLTQQINHNMQTIESSAQENNNQITTVAGIMQEISKGAEHVARVVSSLFK

SEQ ID NO: 31874 - protein, 397 aa, Pseudomonas aeruginosa
CLPVRLLHARTDLFGPWPGERGAGALAGGDPRGHERQPVPLRRLRQYPRRCGRRLAAARSRRTGRAARMTPFAYAKPADIEQALGLAGPESRYIAGGTNLLDLMKENVARPRRLIDITGLPLRDIRRTPTGGLLVGALVSNAELAWNPAVEADYPLLAQAILAGASPQLRNMASTGGNLLQRTRCQYFYDTGTPCNKREPGSGCPARSGLNRNHAILGASEHCVAVHPSDLCVALAALEAQVLVRGRAGERRVAFADFHRLPADTPERDNCLAVDELVTAIELPAPRFARHCHYLKVRDRASYAFALVSVAAALEPDGERIGELRLALGGVAHKPWRVAELEERFRGHPANRDSYVRFAEALLRDARPLAHNAFKIGLARNAIVRALEEAHSGGIGQ

SEQ ID NO: 31875 - protein, 156 aa, Pseudomonas aeruginosa
TGRRWRATTSPTRTPMPPKANPSARCSTTASCTAASPLPWSWHGAWNWPATRARCCASTSSPSRTRPTCWPPSTRPMRLPPNCPPSAAISTPPTAPRRFGSRPATARRSSTTIPWNRTRPRSSSSPTAACWCTTRPRGRRTARPTCKRSSACPPTR

SEQ ID NO: 31876 - protein, 150 aa, Pseudomonas aeruginosa
  UNSURE (4),(32): Identity of amino acid at the above locations are unknown.
TSLXAAPERSARPTRHARPSLLRGGKGWGEGXQHNTRQHLIPKNESAPLKLQLLRLAVGGGCGSAGGNRCAVQVWGKAMAYGRKGCIRPEAVTHQRILLSLTIGGLHSGARWRTVTPDTPNYDILKDVLDDDVDVAVSYRMQVGHGLRCD

SEQ ID NO: 31877 - protein, 427 aa, Pseudomonas aeruginosa
PFLDARETPDQALPSRASVLVLCCVIDEITFAEAARRCRARGQRFGHENSDSSLMTGEDFFAFEIPSVCDRREFLDTHGLSRLLGHGAQLVSIDSVVRDLVRHDQVVLRIDRCLHVVADHSGATRFHRTSIGIGQGDLFIRYFVELNLDLLELLQLRFQGRDLVVEAFGFDLRHGRFLTISGIQCAQVAIDAGLDLLHSPLKLGAGEIAVAVVDRLELAAVDGHQRFREQAKLLAQHHELPTDTADCLAVIFAEVSDGLEVRHQTSGQPHQLNVALSLTFETAAGLDAIEIAVDVDLQEVGRMVSGTTCFSRDDAVETQLAKVEFIDENIDHPHRVGVRHVVIQALGKQRALASMLSLDKTLHRRPPADLNRSNHSKVDANVFTQSGPFSDSPNWRNQYQGRRHTQLPSTFPTPHPFLPNLYPLTAS

SEQ ID NO: 31878 - protein, 529 aa, Pseudomonas aeruginosa
SGFARDSRRVLAGMRAPASRFRMRRGFAVTPGGVVSKLFIIVERKEDWTSYYPSEDVVTAQEYLELPIDDDTGKRVQVINLCRHYKYLRHGYYCSLLAEARGHKVIPSVRTISELARKSLYSLVLEDLDRTLDKALAAHPYGSTDGFTLTLYFGRTDIEPLQDLARQLFEAFPCPLLLVEFKRNRTWHIEGIKPGAIHKLREDQEDLFANALDSFSRQIWRKPRSRKPFRYDLAILHDPGEAFPPSDAKALKNFVRVGRSLGIDVDLIERKDYSRIAEYDALFIRETTNVADHTYRFAKKAESEGLVVMDDPVSILRCTNKVYLADLLRSHKLGMPATEILYKENPQELEKVGERLGFPLVLKIPDGSFSRGVIKVEDQEQLLAASAELFERSVLILAQEFFYTEYDWRIGVLNRKPIFACQYFMSKGHWQIYDHSPDAEEVSGDFRTMPVHEAPRKVVELAVKTANLIGDGLYGVDLKQAGDKVVVIEVNDNPNIDCGVEDVYLGDDLYKLVLEEFVRRLEVKRRGYD

SEQ ID NO: 31879 - protein, 486 aa, Pseudomonas aeruginosa
DDFGIGDINKDSLSRVKKLLDFPFRAPTCRFYDGSKNWRRKGAHMLDASNLRRLLVVDPCDDCRRLLPGLREAGWAVDSCALETARERACDVGLLRLRPFHLERPETVKDLISRSGTEWIAVLSPDTLPLNGVGDFVCEWFFDFHTLPFDMARVQVTLGRAFGMARLRGRGTVPGDAEGEHELLGESLAVRDLRRLLAKLAPTDSPVLIRGESGTGKELVARTLHRQSRRADKPFVAINCGAIPEHLIQSELFGHEKGAFTGAHQRKVGRIEAADGGTLFLDEIGDLPLELQANLLRFLQEQQIERVGGSRPVEVDVRVLAATHVDLEAAIDAGTFREDLYYRLNVLQVGTAPLRERSEDLPLLAQHFSRLYSLETGRRPRRFSEDALAAMAMHAWPGNVRELANRVRRGLVLAEGKQIEAQDLGLECARGDGPPLSSLEVYKLCAERQAMCDALARYGDNLSVAARMLGVSRPTFYRLLHKHRLR

SEQ ID NO: 31880 - protein, 276 aa, Pseudomonas aeruginosa
SAIASACSRRDVWWTPSSATPGPRTRCWRRPSPVTRNATRCWRRREHATQGTRNERPDVFRYRRRSANPATRQLFRPGHLPRPGRRAAGDDRAVLGAEQPLPQLWHLPRHRQPDPRPGGAGGGHDLHPDRRRHRSLGRFGAGPGGLGGKPGDARLGLGRAAGGDARDGLRDPGRLRHRFDHGGLADSLVHRVPRGAGDGPWAGLPDDRLAHGLYRRRLCLAVQSAGVRHLAGLRDRPAGDVRRPGGAHPHGVWPLPDRHRHQRRSGAIGRCEPETL

SEQ ID NO: 31881 - protein, 270 aa, Pseudomonas aeruginosa
DCSIRPDGAARRVGRAVPDLASGSGRPQRRGRPGTPGHRRGGDRRHQPDGRARFGGQHLLRRADHFRIGGGAGADRCVGADQTNHYRGGDRGSGGAGYLPQPSRPQTGLNDGDNEGRGGDGGGFLHHRIACGEQDAAGQRRGAQEGRGRHRAAALRAQRGGALAEGAHHLDHRPAGAEQHQPVFRRAVAGHRGLLRAQRLLRDPLQLRRQPAEAGQLPARAPGETHRRPGPGVRRRRRRAGQGAGEHAHADRDRRPRGGRRGSRPGADRP

SEQ ID NO: 31882 - protein, 503 aa, Pseudomonas aeruginosa
DGRLPGDPPPARAGPSRHRLHRRAAVDQGFDAAGRGLPAGDGQGRPGGAPAVAAGKRVQQPRRLPRGARPAGRRGRATDGDRRRQRHDRHRRAARRGRAEYQGAARTVGDRLRRYRAEPLRVSRLDHRGPVDPPARRDRRATAAATHRRARGADAAAGGGAGAGPARIHRAAAGAGLNRAPGAPSLERGWNKDATMQAKVLVVGSLNMDLVVRAPRLPRGGETLAGQSFTTIPGGKGANQAVAAARLGAGVAMIGCLGDDAYGDQLYRALQAEGIDCQGVERVAGESSGVALIVVDDSSQNAIVIVAGGNGHLSPAVLARHEHLLEQAQVVVCQLESPLETVGHVLRRAHALGKTVILNPAPATRDVPADWLPLVDYLVPNETESELLCRLPVDSLESAGRAAERLREMGAGRVIVTLGAQGALLVGEGRVEHFPVARVKALDTTAAGDTFVGGFAAALARGLDEAAAIRFGQAAAAISVTRLGAQTSIPSREEVERALAGEA

SEQ ID NO: 31883 - protein, 143 aa, Pseudomonas aeruginosa
QGRPVSRPGAVLALRRKPGAGARPSRRRWRGRAADGAPARHGIRDGMPGAAPVPAGSAGRRRSRPRLPARAAGAGRSAAAAGRVRASPGRRRRESGSRGCCSAGGYRGSAAPAVPRERRPPRPVARGRWRGCRRSRCRGAVRR

SEQ ID NO: 31884 - protein, 456 aa, Pseudomonas aeruginosa
SSACCRPLAPGGCTWTDRPSGRCWPIRWPACSHSPSTGGTSAAPHAATGVPRRSACTCSSCSAAGLARWSRSRYSATRPASSRSNWCSGASSCCTSCSGSTACSAGACPPRCCSGSAERRGSLAGAAVGRAGLARGALQGFHEKVDQSTDRRNLAAARQVGGLHGAFRQGPLRQDAHQAAIGQFPVAVAFGQQGDAEAGHGGFLAQDEVVDAQARFAFQLVAAAIRPDQGRVDLAVVMNSAEEGQVFEVFRMFQATPGDQRRGGEDLRGRRSQAPADQRRVLVAEFAHAQCHVHPLVEQVDPAVGQEDFQLDLRVSFEKPRQQVGQVARSHGHRCGKAQPATRLDAQLGDHLFGHLRFQQQVAAVLQVAFADLRERQLACRAVQQAHLKALLQLGDAPRQARLGNPRLASGRGEAAAFHHLGEVVEVVEVVGHAGAPLGGKTDCPMCGTNSHVSTD

SEQ ID NO: 31885 - protein, 501 aa, Pseudomonas aeruginosa
GNEFAVVADEDQRARIVVQRQVQRLDGLHVQVVGRLVHHQHVGALEDQPAEQHAALLAAGDHFHRLLDLVVGEQHAAEGAAHQLFAALGPLGHPVEQAHVVGEVVGMVLGEIADVGAVGPFHLAAVHRQVADQAAQQGGLADAVGADDGDALAGLDLQAQALEQRLAVIALADVFHGHRLAVQLLVLLEADERADPAGRLDLFQLDLVDLPGAAGGLLGLGGVGREAADEGLQLGDLRLLLGVVRQQALAGLFGGGHVLVVVAREQAQLAVVQVGHVGADAVQEVAIVGNDDHGAVARGEHAFQPADGVDVQVVGRFVEQQHVRVREQRLGQQYAQLPAGSDGAHRAEVLLQRDAQAEQQLAGAGLGGVAVELGELDFQLGHRHAICLAHFRQGVDAVAFGLHRPEFLVAHDHRIDDAEVLVGELVLAQLAQAHVGFQHDLAGARLQVVAEDLHEGRLAATVGADQAVAVAVAELDGNVLEQRLGAELHGDIRGGDQLLYL

SEQ ID NO: 31886 - protein, 123 aa, Pseudomonas aeruginosa
SPVFRSSAKDSPMKPAVLPALLVLSLLGGCGDSSSDGKAASGPLALHCGDFGKLEVIDGFASLKLPDGSSVQSLGGDVRSLADGQALSAISYSDGSVLYRQAGDTPGYLYTPAKGQRQACETR

SEQ ID NO: 31887 - protein, 152 aa, Pseudomonas aeruginosa
SEPRRRRPAVASLVEPLESRSPFPARPASMPHLVIEATANLRLETSPGELLEQANAALFASGQFGEADIKSRFVTLEAYRQGTAAAERAYLHACLSILDGRDAATRQALGESLCEVLAGAVAGGGEEGVQVSVEVREMERASYAKRVVARQR

SEQ ID NO: 31888 - protein, 89 aa, Pseudomonas aeruginosa
NVRLVQQVAKRAMTDTPDDRTGDASGLSKRQAFHRQHRQRAEEEARRLLDARAEQGGRWLDWVAGQLYLLRPPEYAAMVRRELQRLSGD

SEQ ID NO: 31889 - protein, 142 aa, Pseudomonas aeruginosa
CLFVRLNAGRSAAGGASRAVGWTTRLAPPAGMSRARPGEQAAGRWGLLRRRLAQACPAGGRPGCRRREWRPRGSTRPGPVRPTAGAAAIAGSPGPGPPPSGHRARRTPGKPASPGRGCASPNARGRCRSSAPPARCTADRSR

SEQ ID NO: 31890 - protein, 151 aa, Pseudomonas aeruginosa
STCCARTKSASIPACSTSPTMASRSASTTSTCMARLTCWRRTSRSTSACWPGSRPATRAPSASTVAACASAATRSCPRTTCSTRCSACWKCAPAPTIPASTCSPRAVRRRSCRRSRPTADGRCTPRKRLARSRRLPDTTRRKDYFLRLAEG

SEQ ID NO: 31891 - protein, 728 aa, Pseudomonas aeruginosa
GSASEPARTPMDRHAQHHPRSRACVLPNGLRLHLAHDPAASRAAAWLRVAAGSHDEPSAHPGLAHFLEHLSFLGGAAFPGDERLMPWLQVRGGQVNASTRGRTTDYFFEVTAEHIGAGLARLIDMLARPLLDIDAQRREREVLEAEYLARSADEQTLIDAALALGLPAGHPPAAFRCRAPRQPGPGERCVPAGPARIPCRPLSRRQLPAMAARAAGTGRAGEAGAACLRRPAGARARRESAAAAVAALRRRSAGAAPAGTAAAGAGLCPRRFAGGRRTDPAGVRRIARRSLAGRVAGGTRRTGPGRIGGAAGGSPGCAAGAPGVDLRTVRRQRGGGAGGGLFRLAGRPARRCRQPAGGAPAVAGGAHCTAGATTPARSWPASGDSPGLPGRAARRPLPAAAPGQRTRRCRSALVGGLPPECGAGCRSAAAGRAAACLALRTAVAAQCRRRGRAVPALALSRCARTVTLSGAAPGVASAVRPGTPGGCGDGPGGARRGLVAEPARSARSPRGRRAPGPGPAPRGAARLARERRASVLRRAAPQRHWPADPAVAGRLARPTRRAAGGGRRLAADALGRLGHAGRDARSPMDARPGCRRAPGASAAEARTASPRTGHGRRVGVAAVLSAAHAGGADGGGLALAGAPARTGLPAAPARRAATGLRVVLRLPRGRRPARPAVRRAISACLPGTPAGAYGDLPPALRRGARATAGATPGRPARSPRRRPAPSTG

SEQ ID NO: 31892 - protein, 415 aa, Pseudomonas aeruginosa
SAPPRPARSFHLAECAMNKNNTAVRRILPLTLASLGALGGLQPAAADILLYDKDETTFSTDGYFNAFYVNSDVDRQGETYDRRQSRVKMGFLPNYIGFNFGRKVDELSLGGRASFWVTINDSETDGTDTAIDVRQFYGTVAGDWGEVLIGKDFGLFSRSNIFLDELLAGFGNPSDTLGLVDGKGVSFGNIGTGYPYPFPTSQITYRNNNLLPGLRIAVGILDPIDSNQIDKDASDGLDDKAYQDNPRYESEVSYQFDLAGAQVYSWINGGYQTSKNTSDSVDSVTSKGVGYGLQVKMGGFSVTGSGFTAKGINPFFTNNAGEAALREVDSRGALLQGSYSWGKNRLALSYGKTVDDGNGLGSAADYESRGIAYFRTINDNLKLVAELNRYRIDGRDGAALDEDTDTVALGAVLNW

SEQ ID NO: 31893 - protein, 408 aa, Pseudomonas aeruginosa
DRGRGGALRRMLARRNDGGAGMYEGQGEGVCRGMSSARDVEVVAQDLARQLIHPHLGFVLFFCSAEYDLPALAEMLERYFGGIDLVGCTTAGEITPAGYGRGCVSAVGFDVRSFAISSALIDEMERFSLLDAQQMVETLVAGCRRGGLAPIKDHSFALTLLDGLSSREEVVLAALGAALGAIPHFGGSAGDDRHLTHTHVYHQGQFHTGAAVVVLVNTWLDFEVFTTHHVVPRAEKLVVTRADSGSRRVHELNAEPAALEYARLVGVAPQALDFALFSAHPLAVRVDERYYVRSIQQANEDLSLTFYCAVENGIVLTAMSTGPLLPNLEAQFRRLHERLGPPLLTIGCDCFLRRLELEVGGDTQATAAFLRSQQVIGFNTYGEQFNGMHINQTFTGVAIGRPRGGVRR

SEQ ID NO: 31894 - protein, 791 aa, Pseudomonas aeruginosa
RRADRRGAARRRPADPVPPARRALAADERATDPRRRAGGALQRRHRDQAQRDRAPRAGAGAEVAPVAAGGGQSLPGRGDGRCRRRAGVVEPALPGALRAGPDRRAPGLRRSDGGERIAVAHAAQPGLPGESAERPRAAPVRWPGAGDPYPCAAHRRLRQHLHRHHRTLSPRRGVARQRALDPPDHRPGAGADRLSQRRTGLRIHQQGLRGVVPLAQRLDARPLPARRAWRRALPAPGAVLRAGPGRRKRDLRDRRDRVVRRGALHAALLRAEPPGRRPGRRAVRADSGYHRAPADRRGAAPGLPEPRTAGARADRRADHPQRPVQARDPRAQPGRGAPARGQARGGTGQPVEDQVPRGGQPRPAATAERRAAVHQRLAGARQRGAGQRGAGEQHQPFAGGRGEPARHPGGHFQAGRRRDHPGHRPVRAWRTARQPGRGVPPGSRQRRATPGLRGLRGAGPQRPATARANPPQPAFQRHPLYPARARAAGLPPASAAPVDRGLGHRGGHRRRQARRDFPGIQARRVTALSPRPRARPGIGDRRQDRPHARPPGPGRLAAGQGLMLRHRGTAGPPCPAQSRRAAGQRGRPARAPAWFAGVGAGQRCGDLRRHAHVARSLGLPGSDGAVGGRPGATGRQLPCRGRPADRRLSPRRPAQRRRRGRRDQRPARLAAAGADDHRQLQQRAQAAGPRAWPYPDAQAGAADEAEDRALPLAGARSLGLIQASSRAARPRRGARIRAIPPSTARVAGGNRGASGSPSSRAPQRAASTGTLSCTEAPWIAVSPGSALYQTA

SEQ ID NO: 31895 - protein, 278 aa, Pseudomonas aeruginosa
HVSTTTMDRSRRHAHRRHPGVAHPADPQPARVRFPLFPPPRPGKTCRLRRRTGLSDRPLSHAMDDLRPAGPAEYRWLLAVQERERRLLAQAVHDDIGQYLTGIRTQLLLLRCTAGDGQPALARLERYCQGLDDSFRALLRGLPPPALQRQSLDEALRACVADWQEGQGIACELRLGGPLPPLDAAAGTHLYRLLQEALNNVARHAGASRVRIRLQCRGGFLYLSVRDDGRGCAADPAPGFGLDSMRQRARCLGAELSLRSRPGQGLALRLRMPLERDD

SEQ ID NO: 31896 - protein, 229 aa, Pseudomonas aeruginosa
EERTMKILLVDDHFVVREGLAALLRGLLPDVEVNEAGDGEEALQAVQREIPSLVIVDLGLPGISGLELTRRLRQRLPQLRVLFFSLHDELALVRQALDAGARGYVTKRAAPTVLLEAIRRVLAGQLYLEQPLATRLACQSWEEQGGAALRGLTRREFEIFRLLARGLALREVAEHLGVSAKTVSNHVSLLKQKLQVSTQAELVHRAIDSGVLRLGLPLPLAEEARGSLG

SEQ ID NO: 31897 - protein, 682 aa, Pseudomonas aeruginosa
SDEQEQRLARPAGAGRSQPLEPGAGPRRCDPPGSGHQGTRAAGQGMARHQPLPQALRQARPRRRDRRLRLQPELRALPRPGSQVRRHRPGPAPAGDRRRGRRMVQGAGHQRRGARWRGVHAEDGRLHQPGRPLGDPQLSGKRARRRVTRPTLRRRPRRPCTSPPRHGGTTTQESFAMIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 31898 - protein, 516 aa, Pseudomonas aeruginosa
SATSPCTVGITWCPAPRKKSSPRSRRRNRTCAESDNDKARPAAWRGRALETHMARFTHSVGGETYRFDSLKDVMAKASPARSGDFLAGVAASNDGERVAAQMALADIPLKHFLDEALIPYEDDEVTRLIIDTHQRDAFAPVSHLTVGGFRDWLLGDAADEASLRALAPGLTPEMAAAVSKIMRVQDLVLVAQKIRVVTRFRNTLGLRGRLSTRLQPNHPTDDPAGIAASILDGLLFGNGDAMLGINPATDSMASICALLEMLDAIIQRYEIPTQACVLTHVTSSIEAINRGVPLDLVFQSIAGTEAANASFGISLKILQEGYEAGLSQKRGTLGNNLMYFETGQGSALSANAHHGVDQQTCETRAYAVARHFKPFLVNTVVGFIGPEYLYNGKQIIRAGLEDHFCGKLLGVPMGCDICYTNHAEADQDDMDMLLTLLGVAGINFIMGIPGSDDVMLNYQTTSFHDALYARQTLGLKPAPEFEDWLQRMGIFTQADGRIRFGDELPPAFRQALAQLA

SEQ ID NO: 31899 - protein, 174 aa, Pseudomonas aeruginosa
GDADERQAPARRQRREPLAAAAPADPRADRPGPHRHQPADPPATGLPVRPRPGARRRAPALRPCGHQRRPAPARPRQPAAAQRRRRPPRLPATPGPRPAPRRGLGATPARTRRRLRRADRPGHRGRRRPLRAGRAASHPALPRTPGGTGAGRRLVAVAGGPGGTGTGGGGRRDR

SEQ ID NO: 31900 - protein, 400 aa, Pseudomonas aeruginosa
IAAGEDERDPDRRASRPQLAGQPRPVLHLGPAGRPHRRLSQLHLQRPPGRPQLRHGRAPPALPDARGLPAAAFRGQPEGRGGGPGAGRRGSAHRQLPPGEGLSLPAEGWAGARRPSFGRFKRSLGLRFPGRLGSIEALLACSLHRPGSPFPQCEARHANRASHPRTPRPAGAAVRQVPRILRHALLPRVLAEIPRETPAPQGVGDLPGAGRRRRPPARFLPALSELLLAVAQARLDPQRHLRRRGGAPATGRRPPAATRQADGPGNPCGAHACLHQRRQRGSAESLRVDRLPRRPGVQELHPADQRRTKLKTKARHLPTDRSEQRHPWVRAPGTGPASCSACSSPRPARRPTPCAWRPSTGRPTSAPTCRARASPAASSTKPWPSTGTAPNWCSCPGNVP

SEQ ID NO: 31901 - protein, 384 aa, Pseudomonas aeruginosa
VLRTPRRQDRDPGALPAHRADLRALRRRHGEDALPALRHVQRGGHRGLGRRPGDPGLLLRQRAVHQEEPVAAGDRHHPAVAAADDPRLHSPSPAGERRQTGQGPERLSMWSFRAWRRRRLLARHPVAEELWQRVRRHLPILDGLDADEDRRLRERAVLFLADKHLTALAGVDLDDFGRLLLAAQAQLPLLHLPELNWYQGFHELVLYPDDFVSPQKHRDASGVVHEFDDERSGETSLQGPVVLAWPGVVGGGGWDAYNLVIHELAHKLDMLNGDANGLPPLHAGMRIGDWASAMQAAYDEMNALLDRDPDAQTAIDPYAAEDPAEFFAVTSEYFFTAPDLLHEAYPAVYRQLQLFYRQDPLQRLRRLQAEHPDYREAAGDTTNG

SEQ ID NO: 31902 - protein, 232 aa, Pseudomonas aeruginosa
SRPLFWPETSGVTHELQQDPGRQGPAERHLRRYRDSGQPCADQVRDRQGHRLPVRRPFHGHPDVLPGQLRLHPEHSGRRRRPAGRAGGDPLSGRSRFGDPRAPGWRPAHDRRGRRRRQADRRAARQAERPVQGREGIHRPAGPAAGTDQALLRELQGSRERQVGQGRRLGQRRRRPRRDHQGRGRVPEVSAPRRKEAPQPRGFFILPRRPPRSVSPPRSAQSTVATLSNRYP

SEQ ID NO: 31903 - protein, 210 aa, Pseudomonas aeruginosa
SSANPPPIRTATASWQDRCAGPATSSCHCCAKACRATANRHGRYRRPRRWPAAPPASGISTSKRTATARCAASTCAKDRSASRARCSPGKHSPMPAPCPCPASTTCATCPAGSVTTPSAFPSSVPTRASPACPTSACCAARCQTACCATAWSWSAPPRRASATAMSPRCRPASAPRRGWRSRPTFSTACCSSAPPSTCNPGSPPCSPPPA

SEQ ID NO: 31904 - protein, 427 aa, Pseudomonas aeruginosa
AQEHHRNPVQGLQAPRRAGPGDPPRSRAAPARRAHRRPRPESEAPGPATGEEPLGKQDRGDFHAHPRGSLVHVQPRPGDQRRPPAGRQHPGRTQDPQPLPPCRQPQHRSTGRPAGHRHAPRRRRYRRTPRPGRHPDHSGPPRRADPSRAQPPDPRQRLAGIRGAYRTRPTGRSVPPTDPRNPRMTAIGTIFRRELGSYFATPLAYVFTLVFLVLSGVATFYLGDFFERGQADLAPFFSSLPWLYLLLIPALAMRLWAEERKSGSIEMLMTLPVSRATLVTGKFLAAWFCAGLALLLTFPMPLTVNYLGSPDNGAIIAGYLAGWLLSGGYLAIGSCMSALAKNQIIAFALTVLVCLLFVGAGTPHVQQALSGWLPQWLLDGIASLSVLVRFEALGRGVLDVRDLAYFCSLIVAWLVATTIVIDLKKAA

SEQ ID NO: 31905 - protein, 603 aa, Pseudomonas aeruginosa
ETSMKRTLYSGVGLLLVGLLFLAFNLLSSLLLRDQQFDLTQQKLYTFSAGTQEVLDSLDEPLNLYLFFSKSRASDLPALRNYARRVEEVLDLYARRSHGNVRLFVIDPLPFSDDEDRAARFGLQAPPIGPNGEAIYFGLAATNPTDGLQVIPFFSPEEEPLLEYDLSRLVQALAQRERTVVGLMSSLPMTGQAPTDGQPGSRPWAMMDKLYQQFDIRTLGLASTEIPAEVSVLMLVHPRQLSEQTQYAIDQFVLRGGKLLAFVDPLSLADADGGKSSDLAPLLRSWGVQLRPDTLLADASFAMIKPNAERRPERNPTWLHLPGDTFPHDNVLTTGLESLNLASVGLLEPLGGASTRFIPLLHSSAHSMPLSLERFRQSSTEQLNATLVPTGERYVLAAKVEGPATSAFPADRGKQGEGLSDSANIHVLLVADTDLLSNPLWLQEQPGHNEPQVWADNDLFVGNALDYLSGSDALIDLRSRGHTKRPFTRVEALRREAGLRAQEQLNALQQSLNDTDRNLRTLQQSMDAGDQEVTPEMEATLRRFIDDKLRIRQQLRQLQFQLNADVERLGEQVKLANTVLLPALLTLFLLLHWSWRSMRRRRG

SEQ ID NO: 31906 - protein, 64 aa, Pseudomonas aeruginosa
AFASIINLQPAELAMGQTVSDHPSRVQKDAYVKKYAKQITSAIPDIRTNPTTTQPQKRTNQHSD

SEQ ID NO: 31907 - protein, 99 aa, Pseudomonas aeruginosa
RLPIKGVRNSKDVKKGDVSLAAFDFPHVGTIDFSCIGQRLLRQAKSDAVSAHYSPQTDQIAIFIMTNGDSSHAWNRHAMMCLRPRHLRPISIKNPAFGI

SEQ ID NO: 31908 - protein, 169 aa, Pseudomonas aeruginosa; identical to SEQ ID NO: 20992

SEQ ID NO: 31909 - protein, 430 aa, Pseudomonas aeruginosa
AICRRSPRSGGDQPGVAQQPTHFIAQPRAGPHQRLRHPMHRLHGLLLCALHRDIAHARTTGGFADRLGVVCIVLVPLDVGFDELRCDQAYRVAQLPQLARPVVRTAAGLHRHQARRQLAKEIPHLCPLELATTYHMLVTINAVHLEYLFCQIQTNATKVHADSPSGTCGCTISLALDAVGGRSPFHCPTRPRSPPNRTRSCVLRGLGVRPRRCSGLDAVAECPAQSGDRLLPIHAAHGRRIGAFAEFAPDEQGQLGAIGKGFGGRHAELLERPVTRVLPEQFLDPVVQWNQVEMHRQAGHVAVAADIDASRPQQRVHFALDPGQQRPEFGEGLFRQLVEGRRRLPRAEHAVAGQGRVDPLVQRPVAGLVDDQLGRDMHGRRSADGTPTVTRRQGRSSPVLRRFISSMRCRSARRWASGLASHQSRTAELS

SEQ ID NO: 31910 - protein, 155 aa, Pseudomonas aeruginosa
GPLGAGSGATGNRYSAAIASSTSRPYSEPVRNGRPRTGFRRRQAPSSREKPAKAPTPACQRSSHTAYRPAPSASVEASASRPRRPGRAGIHQASRAASRVATSSRSTAVMVLRSSFPRGASVGSARTPPAPAADRPARRGRGCQIGGAACRAAAR

SEQ ID NO: 31911 - protein, 443 aa, Pseudomonas aeruginosa
LRAELAAGASAASRAGAAPARARVMAAAWMARDSERGRSVRTGMYRVPRGLCGPWVGADSSTCQPRRKKVSGRGGYFSAEHGMSMATPVPAQRRTACRGGREGAVATGMAAAPSRRHQADPVVGHPAHLQRIGGLQHAQRAPQVQQRIGARHRQPGQLRVAAQYAATVAGEFGEHLGQRHPVGHQHAAGPGVRQAVEDQPARFAVGAQAHRLAAFQPAPASVERAQFDPSGEYRDPGRGHLLAYVEAGGTGMQPRFGGGDAERTRVGAAIDEDLAAQQAYQPLAGVEGQVHGAVGVQGQQAAVGQGQAALFADAGALVGQPVAQRFGLPGGEPQRGAAEDQGEVLDRAPPVQPVLAAEGRQGQRRRQSAEALQQALGALPGMGVLRAALPPLGAGLARVVGAAAVLQAHQPLGGLVEDRRGNPAFARGVHSISSRHWRKACCM

SEQ ID NO: 31912 - protein, 159 aa, Pseudomonas aeruginosa
AKGSCHGLLRICLQGRRGRSARESGRWPRARYRRVPRVPCAGRRCAPGSHPGSAAARGGSSGSGVLPADNGSTGRRGRGRGWRGSARPGGSVPRRCRSSRCRSGCSRAGGRRPAGCRRYGRWGRTSRRPAGCRLARDRCGGSRPRSGPGSPGRRRIPGR

SEQ ID NO: 31913 - protein, 99 aa, Pseudomonas aeruginosa
SPPRTCGGARCATCRKPCAVRKACSSTASACPGGASAFAACPASTPWCWWTASGSPPRPGPSPIPTSTSAGGRWRASSASRWYAGRCPRSTVRKPSAGW

SEQ ID NO: 31914 - protein, 255 aa, Pseudomonas aeruginosa
RCAAASRTLATSAWPTTTRTSPMPNLGGPSISAWWRASDAPFATLLRRAAGQSLCLGGAGPGASAQQRFRPPGQAPAPSRLGARGRCRVARPAPRHRRGAARRVAGRRQPADPRHAAADRSRPGRGGAGRALARRDATLDPRRRRSSGLRQPAGGAGRAPGRLLRERRRSQPAPAVRGGPTLACRPARRRVAGAAAPGAGRLLSSRRTGAVRRPRRLPGLGRLALGQRCPAHRLPDPARRHRRRPDRRHRRTVAA

SEQ ID NO: 31915 - protein, 720 aa, Pseudomonas aeruginosa
SAAVAAAAACRPSGRGLPRQRGAAGPSLPGGLPVRPRGFRRRRADPFRHPWHPGMATRQGPRAGGGRLPAADARRPAGVLPVHPGQRWRGDPGAPARARGHRQPPDAVVRPGRAVRRTARPAPADPRIPATGRGRGARTQRRADPRGGAGGAHERRPGLERGSDARGFPGVPRRAPRPPAPTGRLGDAAGAAHLRCRRLAGAAPGHRHAAARRALLPRARSRPRRTVRRRFQGAAGRSCLPHAATLPARRWRDRQGGRSAPARAVAARPRTGPPARRHRRTGGAARRPRRALRRARAGRRSDPQSAGTQRAQPVRLRGRQGTDPRRLRSRRRGLRPTAGKLPRRAPGQGAGKARLQPLVVGNHAPPGHRRKPGAARPRPAPALGRRWPPAGAGHRAGGGTGASTGGRGATGDQCLPRPVRRLHAPARRGHRAPRRAGRAGQPAGAQQPGAGAAPARTRRRSATGAAPVAPAAVRQCAGRLRHRGNATDPRFHPLGRRLGARRAVPRALAVRLRQSRLGREAGWRQPVRRTVEGCTGGDPLALLDAQRRALHRPPVRVPRRPVAGGTPPRRRQPGAVHRRPAPAPAAHHGRRAVPRQRAARALPQPAVDRRDAARGLRRQPGNARPGQQPVGLAGGGSHHGPRRPVAGVARHLRHGPPRAGSRRVVRNAQSDRPGADHRAHGRGHPQGLLGRQRADPPRTGRALAATGGRRRRRGRRGDHP

SEQ ID NO: 31916 - protein, 236 aa, Pseudomonas aeruginosa
IHRTDGRRFRRGRGAGRGRGRVRCRRNGQRPRPRRSRAAAVRRAAAVAPAGRRRAARAVRRRRRPAIRSQSSSDGKSLMNGLETSLYELTRLFLLPVLLLILAALAYAFVALGGFAMEAWQRRRGRYRSRLAAWQALHGGNSDDLELWIMQRLEWLRITSRSAPMLGLVATMIPMGPALLALTRNDAQGIGENLVVAFSAVILALVAASITFFILTVRRRWLLQELRAVERAREAG

SEQ ID NO: 31917 - protein, 760 aa, Pseudomonas aeruginosa
FHGDRRPADPLQGRRLRAGAVRLLPGVVGAVCRLLRQAVLPDAQHPHRQHTPVAEQHRRPGEPLPADLQDPGGTAGRHLGEGPPGHPPLHRPLHGEEGGADRARVRHRGGRQPRCRRPGAADARHRCRRLHAHPGQGPAAGADHRQPVGHPRRPRHEDRDRLLAQHRAQRLVAAHPRCAVADVLHQRQGREQGKRAGLGAGRIHRAAELQLLLQRPVLGRRDRQCGVRPLPGRTLVQARPRRCAAAGTARRPLPGDLRPRRRAARLAPVRHQLGQRAARYLRLALRAPVRRPGGVFPLQPDREPLPQQRHERRQYPGRGAGAVPVGDLRACGQAANPRRRAGAAGRAAGGAGQVPGHPRRDPRPGRAGLPGTGQGRLAGRRIPGDVRDPDESAHRRRVRFLRRSPELRGGPGAQPDRTAPGAQLRRPERPAPADLRKPCADRAEQLRRAFHRFQRRGVLALLQRQGRFPVRRVGLHPAGRGCQRRGSRDPVRHPRSHGQAGLHGGVREPRRYGLPDPGAGLLGNLSGGRPDLGQHQQGPGVPRGHPQPAPPRRRRARGVAGAPGRLRGGRLHRHHHADRRRVRRQHGLGPTDHPRAESAHRPRPEALRRRQGRRGGVPPVQRQQRRARPVLPGAERGAGGRPRRRAGDRRLRGQFPPHVRRRADGCRAGLGGRQRALLRPDADQHEAGRARPAPAADRQLQEAARGASQDAALGRRRGRRCRGWRSQASAHGDPQAQVRRAPRSGREDDHEGNLISSRRN

SEQ ID NO: 31918 - protein, 302 aa, Pseudomonas aeruginosa
PGADPFADLRRDPRALPGARRGRADPAYPVRHGPWRQRRQLLRRCPCPGNDQVVRHQLSLPGPRVQRRSAVPAELGTTVRGGRRGQGPRPPGEAGADRSADLPVAGQGQGRRVRQARPAGPPAAALRPDLAPPRRPGRGVGADRRADPGPRPAAGMEERLRARLQPATERTAEEAGRHLLRRPGRQPGPGRQPPGGRPAHRPGASAGTVSEHPRPPAGLQGRLAGPGQRTQRLALRPGESPGSGTPCPGAPGRAAVGRAVLLAAAQPGGPGARRRAGRRAEELAGLRRAEVPRSRGAGPCRH

SEQ ID NO: 31919 - protein, 439 aa, Pseudomonas aeruginosa
AGGRRGACRPGREPCGPGQPRFFAANPQAGRAGAPGRDQGQRRPAPLAVRRTHRQAARRTRPAGVPDHHHRLLPADLVDPPGPPVVQAGQAERGRVHRGDAQRDPPCGADPGATGAGRAGARRGRAQRHGRVLRRATGRLRLHPLRLGAELRLALREAGGDLWRPEPSAGHDRGVDQVRPEPYRQGDEGHADRPGDHADVVLPARGRVSRGAGAPVGPGDPRRSGRPGGRRHQDRADRRGGFPRRPAAAPQRLAALSGVGHRGLPPVRLRSPRRNPDPYAHVLQRVQRCDRVHRRHGRRRDHHRDFAFGHGAAGGLRAVRLPERDRSGRLRHPFAARAEPGRDRRAAAQGGPADTRRAALGQPGLRPEDPRLAGNRGSAGEHGRRRPRTAWRPRPRLTGGPGERNGTPGVPFRICTSVQRGASTSARSTWSSQTPAIFR

SEQ ID NO: 31920 - protein, 196 aa, Pseudomonas aeruginosa
TYLRAVRSDLKKRHPPRRCTDREACTMTNPEPADLPISLLINGQRRELRVPPWLTLLDLLRERLDLVGSKKGCDHGQCGACTVLRNGRRINACLTLAVMCDGDALTTIEGLAEGDRLHPLQQAFIRHDAFQCGYCTPGQICSALGLASEGRARSRAEIREGMSGNLCRCGAYGNILDAVEDALPLLDRDGQGGQRA

SEQ ID NO: 31921 - protein, 250 aa, Pseudomonas aeruginosa
RCATGPPTPSPWSRWRRPWNRTASALANCAWRSAAWPTSHGASQSWRNVSGATRRTGTAMSASPKRCCVTPGRWPTTPSRSDWRATPSFAHWKKPTREGSANEQPATQHRASPGSRRRASQGHRPGSLRRRISCRRPAPRQRGQQRRRPRPGARHRLCGGPGGTRGGRGTASPEPAADGGRRRALQGRRCRRRRTLPPAVRRPRPVQRPAPCPGPGTEPGTGPLRGLAAAHRHRARAAPDRPAGRPRPGP

SEQ ID NO: 31922 - protein, 430 aa, Pseudomonas aeruginosa
GSRRTARRARRFLHRLPRRADSGRGQLQHADRAPQSHGTARVHGHRPARRQPAGARQDPGDAEQPGLPAKGLRPARRQGKGLCRLRRRRLRLRPASAIPVGPGGDGGAATAAVGARSADPPADVHLRLPAAHPAAPSTGRRCRGAPPCAGPPGDSADLALRRLHRARGGVERHALSLREPFPGLPSGAAGRLYPAGHARPRRGAGADRAGMRDGRTGGAARHGPHRAAPVQLRRAQRQRGQAVLQQGAAGLLRGGRPALRLAGPRPTATEHERRAPVARLGHGRRRLGGHAEQGQREGAAGGGRPAAGGQRDHGYRHRHLHGDDPDRRRRRWHGAGRGALPAWRQCVAQGSIAGRLVHRLVGRFRRPPGLPAPAPGPGRPCQGPPSGAGRHRRRTLPHMPWPSGSGRYAIRPGRPAARAAGRRVAGGGGS

SEQ ID NO: 31923 - protein, 91 aa, Pseudomonas aeruginosa
LDLALCLFPGAAHDPSFSKLLLRTPLDGAQRIPGVQPGARLLLHAEGENPVRAVLARIDAIEALGIAPVGVSPAYWRTLANRLAARLPLAL

SEQ ID NO: 31924 - protein, 61 aa, Pseudomonas aeruginosa
KQVISDRIRQSDLSGNDLGLAQAEDVSVMGDASALGILLNNLTAKRGQKDGQKGTDLFFLF

SEQ ID NO: 31925 - protein, 160 aa, Pseudomonas aeruginosa
RRVGNGRFPCTGDVRGELSIQLSALLSFLLLPLLVLNFLTFLARLIGALNYLLGLGPATYLDLPIALGTGLIFVISRADLPDKFSDHAGLGNFSEREEIGYAFQVRAFLVHGPIPLRQLNLLTVCSFKFQPNCHVATCIIKEFNDLEKSVLPRSSSKKGS

SEQ ID NO: 31926 - protein, 249 aa, Pseudomonas aeruginosa
SSPSCSATRRAPSPARTSARSGGSRRPTAAPCSSTRSATCRWSCRPTCCAFSRNSRSSGSAVAGRSRWTCGCWRRPMSTWRRRSMPGRSARTSTTGSTSCRSAPRRCANGARTCRCWPSISPGSTAWRPAAARAASARTRWRRWRCTPGRAMSANWPTGYVAGWSWQRESRSRPRTSAWNARAATARRCPAWRSTSSAPSARRCVMRWPVTATTSAWPRGCSGCRGRPSTACCTSTGCAEWAAGDLPAR

SEQ ID NO: 31927 - protein, 577 aa, Pseudomonas aeruginosa
GVVRGARGGDLRHFRTDRLRAHRIVAPDLRRRPRRRWAGPARRSAAAPEPAFAGRLGAPGGGADHRGPQGRGPAAGPVDQRQPGPGQPAGAGAPRGDRPAPRGSPGAAPGGGAAGALRGHRAGGGRTVRRQPAEGGDRPLAGARLPGAAVRRADPWHRRRRQVRHLCLARRTDPPGQGAGGGVQRPARADADLRSHRRALGGTYGGHLRARRLDPGRAAGGGLRRLQETRRAAGDVVNTQRKEPEMSDPTSSATAAAAPTLRRGNYFGLGTYLGLAGALLAMIALFSALSSHFLSYGTFLAIANQIPDLVVLAVGMTFILIVGGIDLSVGSVLALAASAVSLATLGWGWGVLPAAMLGMACATLAGCVTGSITVAWRIPSFIVSLGVLEMARGLAYQMTDSRTAYIGDAYAWLSNPLAFGISPAFVIALLVMFAAQAVLTRTVFGRYLIGIGTNEEAVRLAGVNPKPYKIAVFALMGLLAGLAALFQISRLEAADPNAGVGLELQVIAAVVIGGTSLMGGRGSVVSTFFGVLIISVLAAGLAQIGASEPTKRIITGAVIVVAVVLDTYRSHRARRQG

SEQ ID NO: 31928 - protein, 338 aa, Pseudomonas aeruginosa
TMATMKDVAAMAGVSFTTVSHVVNRTRPVSDAVRKKVEDAIAQLHYVPSAVARSLKVRTTSIIGLLVPNSTNPYFAELSRGIEDCCERNGYCVILCNSDDNPQKQANYLRVLQEKRIDGLVLASAGGDGALAKGLANMRTPTVIVDREVEGVEADRVQIDHEMGAYLATRHLLELGHRDIACIGGPLSTKVSTLRVEGYRRAMAKAGLEVRPQWLLESEFSSPGGYHAALGLLGGEGERPTAIVAGNDMIGIGVLRAAAELNIRVPHELSVIGFDDIELSRFVFPALTTVGQSIRLLGEIAAQLLLQRIAEREEPMQRRVVAPALVLRESTAPPLVRV

SEQ ID NO: 31929 - protein, 466 aa, Pseudomonas aeruginosa
RLRRYPPCAARRGSLPGSRIPSRGKACPGSNGGPSEVVGEFHAEGEVRRVRSDADGQAGHDAEPVAHRIGHAQAEVAGVGVAAADGLPALAVLLDLALLADQFGEGERHAHLLVQREGHADAELEPVAELDLAAGLHALLRVDVVERLFEVVGIRQAAEQHRRVHRLHQRDARGDRPDAVAGGQVVGHVEVVVARYLLQLDAVGILAGGRLDPQADHRVRGALAFVEELVGDAEADVAQAWVAGHRFLGDLRGRAAGAGGLVGRFAIDHRGVDIHLPALVPVVAAGQVEGPDVGIDLVHADVAEEDRVQRQEAVEEQLAGVVVAVGEAGLQAEGAAAEEAAGVLVDVFHAGRGRAIVLEAGAVGAGDRVGVVARLRRRLDRLDQALRLRRLGLRLDLAHALFEDHQGVLLGLVALAQLQEFLLQRLDLGLRRGLRQERGNQGGGAEDSSQRECLGHVCRSVFMAFR

SEQ ID NO: 31930 - protein, 303 aa, Pseudomonas aeruginosa
GLHKRRRVYRREQRKLVRDSSRRGRNMEWWTAFQAFILGVVEGLTEFLPISSTGHQIIVADLIGFGGERAKAFNIIIQLAAILAVVWEFRGKIFQVVRDLPSQRQAQRFTANLLIAFFPAVVLGVLFADLIHEWLFNPITVALALVVGGVVMLWAERRKHVIRAEHVDDMNWKDALKIGCAQCLAMIPGTSRSGATIIGGLLFGLSRKAATEFSFFLAMPTMVGAAVYSGYVYRDLFRPEDLPVFAVGFVTSFVFAMLAVRALLKFIGNHSYAAFAWYRIAFGLLILATWQFHLIDWSTAGEV

SEQ ID NO: 31931 - protein, 259 aa, Pseudomonas aeruginosa
RSLRSWGMQALRWGEKQIVLCVGRIVMFLPTNRRLALPVGCKPLDRHTAIPHFQERDMKLLHIDSSILGDASASRQLSAELVQAWRQNEDGLDVTYRDLAADAVAHFSALTLAAGSTPAELRDAALKHEVAVGEEVLEEFLAADVVVIGAPMYNFTISSQLKAWIDRIAVVGKTFRYTENGPVGLAGDKKVVIVSTAGGVHAGQPTGAAHEGYLRTVLGFFGITDIEVVRAEGLAYGEEPRAQAIAAARRQIAGQFAAA

SEQ ID NO: 31932 - protein, 95 aa, Pseudomonas aeruginosa
LSSARFSASMDSMSRWLVGSSITSTLGRLRISRPNSMRPCSPPEITFTDFLISSLENSMRPRVPRTSCSPPWVHWAIQSNRLMSSAKSSAWSWAK

SEQ ID NO: 31933 - protein, 218 aa, Pseudomonas aeruginosa
NPAPHSPQGPPACRISSSKPLPTSASKRPPANCWSRPMPRCSLPGNSARRTSSRASSPWRPTGREPRRPSAPTCMPACRSSTGATRRPARHWASRSARCSPERWRAAARRACRSASKCARWSAPATPSASSPGSAERLARAWLRSRRSASRGPASGPLAVPAPGRSAWRSSRACVRRCLSPPVRVSPAASRPVPPRLGRGSSGPARASARRAISACTP

SEQ ID NO: 31934 - protein, 149 aa, Pseudomonas aeruginosa
AATEAGEFVSADCSFARKPMPLVRWRSQKIRGGGMPLKQFSSALVLAALLAGCSSNGDGPSTEGASVATGSASAPAATPAADGRCDANAVQAYVGKQASAAIVEEARRAAGAEVARALRPHDAVTMDYNPRRLNIDVDDTLVIKRLSCG

SEQ ID NO: 31935 - protein, 241 aa, Pseudomonas aeruginosa
TREEALPAAPAGPWGGRRDWRRPPACPALGRENKRQAAGACSGGDLRRLAQQAVDQAAGGESGDRGDQPGQALFGQRQVQQPLREVLAQARRLQGIEHAERQGNQHHRGEDARRRMPEADAEAQRHQHDARRIDRGEHRDRDLDQLGQAEVGNDEGEPCQDDHQAAVGQRQALAEVLGAGAGQADRGDQAGQRDKSRQERAAEAAEGMLHVGMQDRRAVAGVGGDGMAAGAEPEQADVDQH

SEQ ID NO: 31936 - protein, 255 aa, Pseudomonas aeruginosa
ADTGDQPGDDGIAGDQPRRLHAAGTDGVDDDDAEDQRGEGVHGQVAVDETLGERGLGVLRLGRADRAGGPEEGGDAENRQGEDLQRGEEASDGVQQATGVEGDGQGEEEVRQAVDEQRRAALAEQRHHADLEGHRGGARNGEQRADRQVADRRQQAAGIPADRMAEGVDRTADLGQGDHGDHRQPHRGDQEAQRRQPHMGAGLQADDGREDDVAGPDEQGKGHKTKRQDVPAFQSVHAGEVPRCSRKFTEGFPGG

SEQ ID NO: 31937 - protein, 410 aa, Pseudomonas aeruginosa
  UNSURE (347),(352): Identity of amino acid at the above locations are unknown.
NPAESPGIQGLRRFRRVTFSVGILHERLTDCRADCRRRRVLPGATLRTATRKSVKIRAHVESPRRPSRTADPAGQPRLPAVLQPAAVATPAGDHPGGLAGPRHDAGSRPDDRRDLQPGADPAGVPLAAQAGADPADPGGRRYHLLHDPVRRADGRRHAAQRHADQPGRGRRPAFAEARRLPGVAWRAAGLAAVAHAGALPAVATRAAEQAAGGARLPGPACRGGAGQLPGAVLAVPQQQGTAPAGHPEQPGRRRHRLRQGPGPGRQPAAAADRRRCPARRPVAGPCAQVADRAGGGRERAGTELRPQRLRSRDQPAAEGRRRPDQLLQRALLRYRDRGVGALHVLQXGPRGXQRRSRAHPGRPSRCVAARRPAGPVAGQPVRLQGHLRPRRLPGPEREQGSGPVRRRRVP

SEQ ID NO: 31938 - protein, 314 aa, Pseudomonas aeruginosa
RDPPARLAGLHRRAATGHRAGPAPDGQPRPGLLQALSQGVREVHPGLRQQRLQRLLAGQHHQRLRQHPAVHRPRAGQPDRPAAQERRAHRYRHALPLRPWRVARRVQPLPAWHALPAGAGPAEARRHAGLVLARLPERLRPRQWLPAPAQQRGAVPGQPVPLDARPAGSAHRRLRSRPRPVRPVPCAGGPAGAQGRRRTGAVLRGSVWPGAAGFLIRPGERTISFASRKGKVQPRNPRGRPWIATPNTTPGAAPACCPTACACTWRMIRRHRAPLPGCGWRRAATTSRARIPAWPTSSSTCRFSAARRFPATSA

SEQ ID NO: 31939 - protein, 628 aa, Pseudomonas aeruginosa
STRRWPSACPPDTPLRRFAAGRRDSLALENDAFQRALREFHAAHYHAGNCQLWLQGPQALDELERLAQRACADLPGRAPGANPPPPPLLPFAGEALALRLPGPPRLVLGFALDALREADEQTLQAFAELLGDRSPGGLLAALGEQGLGESAALRVVHRDARQALLALTFELFDGSAAAALEAAFFDWLGDLRDDAASLLAARRPLLAEPTAPLERLRQRVLGLPAEIRPACLDALRADRCLRLHLDSELDGAEARWSAGFRLSVAPVAAAPPLAAQRHAWRFELPLPPSAAAEGALFLRWRFPGVPARSRFLALRQALRPLCGQARLGGVEMGLEALGEDWSLSLLGPRDRLEAAVRPALARLLAAPPDWRASGERLSSAERRRSATGLPIRQLLDALPGLLGEPLAEVDDWRRTRWDALVMQAAMPDPRWMPGQAAGERLEPLPPRPGRHRRELAMDGESALLLFCPLPTQEVPMEAAWRLLARLHEPAFQRRLRDELQLGYALFCGFREVGARRGLLFAAQSPRACPVRLLEHMETFLQRSAEALAQLPARRLAGLREALADDLRRAPGSFAERARRAWAEHLGGGAGRSRLLAEAALGLSGDDLLAAQARLLEARGGWWVLSSRR

SEQ ID NO: 31940 - protein, 135 aa, Pseudomonas aeruginosa
SARTSACSRARTSSSTNCWPVSATPATPSAWWTARASPSATSAPAIRIRSPPRRSPTATTTCCPACASPWASSTRSTPTRSTKMPATASTTRPTRTTRATRARSATSSTWPGRRSTAGSTAVTRLRRTPATASTA

SEQ ID NO: 31941 - protein, 891 aa, Pseudomonas aeruginosa
SASTPTESNSMACISTRPSPGSPLADPAEVSVAELQARVVALEEERHKLQRINQALIGRIESSAAQSDEAYGAFQYSVVLAEQVRERTDALSQTMLELKASNQLLSDARLRAETAHQHLLDAIESISDAFVLFDPQQRIVLFNERFRALWIDSRARIGPGMRRAELHRLARSGGLIVEEQRGGDQQTLYRLRDERWLRMSERPTRDGGLAVLYSDVTEIKLSETARREQALAQKSHLLQRAVDNLSQGVAMVGADGVLELWNRRFLELCGLAPIAGHRAFAEVMAESELPLLTPRSQDSQGSPLSAREQRLFDGRVLEIRTHALPTGGFVNTFTDITERYRHAEALRASERWIRLITDQVPALIAYLSDELVYEFTNKVYEEWYRWPSGSMLGRCLRDVHGAEHCRRLEPYFERALAGESVTFEIAETALSGEERYMQRSYVPNRQADGRVAGLFVLIRDITERRRTAEALHQAYQNLEQRVRERTAELTTLNDQFKREIHERSQVEARLREAKREAEQANLSKTKFLAAVSHDLLQPLNAARLFTSALQERGSAARDNEALVNNISHSLEDVENLLGTLVDISKLDAGVITPDIAPFELGELLGNLAAEYRQVAASEGLRLDFVACGALVRSDQQLLARILRNLLSNAIRYTPRGRVLLGCRRHRQRLSIEVWDTGVGIAADKLGEIFQEFKRGESQRCHQDRGLGLGLAIVDKIARMLGHRVRVGSLPGKGSCFAIEVPLARHAPRSRAEPLASADDLRERLRGSRVWVLDNDAAICAGMRTLLEAWGCRVVTALSEEDLARQVDNYHAEADLLIVDYHLDDQRNGVDAVAAINARRGSPLPALMITANYSNELKQQVRELGHTLMHKPVRPMKLKTALCHLLEREASV

SEQ ID NO: 31942 - protein, 662 aa, Pseudomonas aeruginosa
RGRRRCRRRPGPGRRRAGRRRGGRSSSGYSAGGESRASQGAARGSAAGGAVVPAGQLEYPEGTALGHRPGQVGHVAAPQRHGAAVADGHAEVLLAVLFPGDRWRDDAAAGLEFPQLLAALRVEGLEVAVAGAGEHQVAGGGQHPGPERQVFLVFPDHLAADRVHGAQAADVVVVHALDPEAHAKVGAALRIADLLGPVVFLPVVGRHVEQAGVLAVGHRVPVLAAEERRRYFHRLAMLLPRFRQRRALALALHRAAGLQVDVAGPGDVVDEGEGVLQLAVAAVDHIEEAVAVGVGGGLDDLAVLGLVVEQHQFVVAGEVPGVVGGVLVEPLHLAAARVHPDLAGGVEAVVVVRIAALGGARPGVPRAGVAGADDDGVGLGVEAGALPGSAAAVAPRLDLAGRRVAIVRPGGRLDVAGHRAVLAVQAAHVAFDEGTHPDFLAGIRIAGEQAADHAELVARTAVDQQDLAGLAVLHDGRRASHGVAGAVIGELLLPHHLAGVLVQRHHRGVEGAEEHLVAIDRGAAVDHVAARADVVGQAVVVGPQALAGLRIEGEQPRVGGGHVDHAVADDGLGLLAALFLVAEGVRPGRGQLEHVVGVDLLERAPALGVGAHAVLQHVAGGLVVVGDVLPGHILGQRGASAAQGDGEGEAVQARAQEAGRGG

SEQ ID NO: 31943 - protein, 181 aa, Pseudomonas aeruginosa
ARTPKAGFGCAAELPRMAMSAVWRPCLVLSPRRNEVMNKNNALRGLLVLAGLSLSSLALAHGDVTPQAVDTKGLEPLGKEWRDTNPYRKPYAKHDLAVEIGASAYNQNCARCHGLEAKSGGIAPDLRLLETGAEGDEWFKERVINGAVRDGAVYMPKMADFISQEGLWAIRSYLESVHVDE

SEQ ID NO: 31944 - protein, 152 aa, Pseudomonas aeruginosa
WPPGSWPRRWPPATAWCSSRPSRPRWASACCWNSSATCCRRACSTSSRASAGRPARPWPPASASPRSPSPVPPRSARTSSSARRRTSFPPPSSWAARARTSISKTSCRPSRRSSRRPPRAWCWPSSTRARCAPARPARWSRSRSTRHSWKRC

SEQ ID NO: 31945 - protein, 160 aa, Pseudomonas aeruginosa
KRSGRSSAATRWTPRPWSAPRLPSSSTRRSSPTSTSPSRKAPSCSPAAASRSSKATWPAATTSSRPCSRGTTACACSRRKSSARWSESPPSRTKPRPWPSPTTPSTASAPASGPATSTAPTAWAAGSRPVACGPTATTCTRPTPRSAATRSPASVARRTR

SEQ ID NO: 31946 - protein, 525 aa, Pseudomonas aeruginosa
KTHVPRTNRPCARNFRGRLRKRRRRLLPTPSTEERRRRLGPAGRARRRLRDLRRLRRLELRPGPGRLGRDVPRHPADGHHVPVHVLLARRAVFDDPYRRRRKRLRPQRLRALGRLPHRHRDPHRIRHRPGGHRLLHRRLLRVAVRRRRLADLPGVLHRIHRHPHPRRRRGAEADVRHHRGGGHRPRRVHCRDGSALRLGQPVQHPADRGDRRQQLPAVRLCRGLGGDPLRDLVLPRRRRRAAGRRGNQEPQARPAARTDRRHVGASRLRRTDSGRRSRGRRSQGADGLGQSPGGSAGVGLQGFDLDEPVRQPGRPGRADRQLLLDHLCLLAADLRPLPRRLPAAQPLADQPQEGAGTGPGGAGGDRLRLVADRPGRPADPGRGVRRDHLLRADDGRAHHPAHPPPGHAAPLPHPWRHPHLRRIPGAGLRRGGRRLPGRPAGRGRRGGDLRCTDRLLRPVQSASPGVRHPGRRVRRDPGGGTGPALRATTTKPGPPHGEAGHWRHTWHVSPIASAAKPTASTASRT

SEQ ID NO: 31947 - protein, 318 aa, Pseudomonas aeruginosa
SRRRNSRTGCSGWESSPRPTGASASVTSYRRRSARPWRNWPEEMPMNDKHLPDASAENPWLPLRQLTPARIALGRTGTSLPTRPQLDFQYAHAQARDAVHLPFDHAAISDGLRQRGRDSLLLHSAAADRHVYLQRPDLGRRLDEASVQRLREHAAGYDGQIDLAIVVADGLSALAVQRHTLPFLERLEEQALAEGWSLSPVVLVEQGRVAVADEIGELLRAKMSVILIGERPGLSSPDSLGLYFTWAPRVGLTDAYRNCISNVRLEGLSYGMAAHRLLYLMREACRRQLSGVNLKDEAEVQALDGEAPRTGNFLLARD

SEQ ID NO: 31948 - protein, 207 aa, Pseudomonas aeruginosa
ASRPKDGPARVAPPSADSNVRLDCAFQGDWAASKRCWHAACIVPAAPSRNARPVMRIVQATLEHLDLLAPLFVKYREFYGMLSYPESSRKFLEKRLRRKESVIYLALADEEDRLLGFCQLYPSFSSLSLKRVWILNDIYVAEEARRQLVADHLLQHAKQMARETHAVRMRVSTSVDNEVAQKVYESIGFREDQEFKNYTLPISDELS

SEQ ID NO: 31949 - protein, 495 aa, Pseudomonas aeruginosa
RQRHGTSQPIAQSRGIHGFAHLALARRPARPAPRHGRRAGRHPARGDPRLGALRRPRPAGQGPRQPHPRRSPGPRRAPRRTGVPALATCPEGSRRGALRRSHAGLPVARAARTVPRHHPPARLATGLLPPARAPAAGQSRASGKPASVPHRRGPRLRQPGGFRRRPQPDQGRGDQRLAEPREAPARAYRPGRGRSLHRLPPAGAQRAGAEGSPGVHRTAAGGQAALCTGAEKTRPRRRPCRQPRPQPAPDASQRPAGTTDRRSTPRTQRADPHAGRRSVNRPGRPAAQPRPGAGPGPARPVATGVARRPAGDALAASARPARIPTTLRSAPPDAAPGPAPIPHPSRPAGPPDARPGARSGIRRRSPGRRSTASDHRAANRTAPPGRTGRPGHRAPRRDATPAPAARCPQAAPGAPPPAGSPPPRGGTAGARPRPAGSAAAPSHKPCTPRRCKARTASISCSRRTSAHCGSSGRCAGAQSSRLRIGQRGGANNWKA

SEQ ID NO: 31950 - protein, 177 aa, Pseudomonas aeruginosa
RRNRGDDNTRGRLSARQRRNAHSRCQNASSASTAASSSNASRPCSSQARNSRPGGPNAQAACKVQPSTQSPGHAAPSAGQPVCRGAAGARSSAPGKTSATAPGACSNGCSTPSRRPVASPAQRSPRARRSATSSSGWGASNKGSPATWVRLCWTSASSALLPSGWPLPPRRCRLPWR

SEQ ID NO: 31951 - protein, 236 aa, Pseudomonas aeruginosa
WRPSAAQRVVSAGCSMDFNPIDLILHLDTYLAMLVSNYGVWIYAILFLVIFCETGLVVTPFLPGDSLLFIAGAICATGGMDPWLLGGLLMVAAITGDSTNYVIGRTLGKRLFSNPDSKVFRRDYLDRTHEFYERHGGKTVTLARFLPIVRTFAPFVAGMAKMHYPRFVMFSVVGTVAWVGGLVTLGYFFGNVPFIKKNLSLLVIGIILLSLLPMILGFIRHRLQASAAKQAKAQSD

SEQ ID NO: 31952 - protein, 285 aa, Pseudomonas aeruginosa
TPCSTATPTRRPPSTPMRRKIRRSSSPLPASISSPPRISSTRPIRRYTGSSSCSTARTRCNACAACRPSIRTTARRRATRLTAECRYMASTTEYAYNRGLFFGQKPLESPMSYSKIPAGKDLPNDIYVAIEIPANHAPIKYEIDKDTDCLFVDRFMATPMFYPANYGFIPNTLADDGDPLDVLVVTPYPVAPGSVIRARPVGVLHMTDEAGGDAKLIAVPHDKLSVLYKDVKEYTDLPALLLEQIKHFFENYKDLEKGKWVKVEGWGNADAARAEITKAVAAFQK

SEQ ID NO: 31953 - protein, 110 aa, Pseudomonas aeruginosa
PLSGTKSPRASASLTYQGVVAMGFRPVSQRLRDINLQALGKFSCLALVLGLESVSHPAGPVQAPSFSQGTASPSFATPLGLDGPARARAEMWNVGLSGAVSVRDELRWVF

SEQ ID NO: 31954 - protein, 703 aa, Pseudomonas aeruginosa
KGPHHEAIRSRVLRHLLAGIGRLRQRSTRCRRTGTGNRLPRRGPGVRPQRADHGLCHRPDLRRPPEPRGIGRPVGRRALPGQPTAALCRRPGPRWPRRRRRAVPDRQRQGRLRPGRRLRLQRLRRTLAGRLLVASRAGQRSGTYRHVPADHPRRHLQARAAGLRADRHRPDPDPDPPDQHPGHQHLGEPGAQHRGRPVRRRLGGFPAVAVLGRADSRCGTRRPGLSPDRRQERLNRSAWPNRQALRPRKRQGSLRAPDVVARIAKPAPDQADCSLTGPPAIPDPPPSEAYDSPRPYFPIPLSGLRRPGAGRTVDAARRLRRGRAGQDETAAVHRAGRNVPAPAAPRQRALPRRRRLEARRQGQPDAPGRRHGHRRTGRRQDLSDRLRQPAARRRQPHRPALQFGSHPAPRRGHRHSADRPARGAGRVLCPEEKERSRPLPGADPGRRTGRARYPLPRPHRRRPGADRSARRARRGEPRADQRRPAAQRQAPGPQGGAGRAGRGRAGRRPPRPEGQAAGQADAGGPATRPAIARPGRRARRVAGLEALSCPAARRQALPCPGSQRSGLPAHPAGAFLEHPGSQFQRTQGGLLPRPSLGLRQRRTGGRDQRIRHSLLPARRQCPIGHRGLADEGARPPGRAQPGAAAVPRPGARMAAGQPAAPSAHRPAFAEQRPAAEQPALRPPAQPRPAGRRSAHPRRRHRRP

SEQ ID NO: 31955 - protein, 147 aa, Pseudomonas aeruginosa
PGKPRSLALAAQRPRRAAGSPGRRRRTQRTARRDLQRTLLQSGQRPPVGKIAVPGRQRPPATAARKRAALRRTATGDTADRAAGRLRRRHRAYQRRSGQRRHGAQRLPARRTARPAAPAARLASIRRCRRHAHARPRRHAQPARLAA

SEQ ID NO: 31956 - protein, 332 aa, Pseudomonas aeruginosa
PRHPHSLHRCRRGLPQRALRQRVARRGARQPAARPPGPGRRHRAGPRRPLCHPAVGQPRHHAGGGDPGQHSQRPVAAAHRRRPATLARRPALRRQRSAAARPDAVPLAPRLAPHPGLRGPGPGSFLGAAAQRLVVVAAGQPGRPAAGLPDLELAPAERGARLLRLGTGAPRPRAQGAARAGQPPARRQRSIAEPHRRPGAGGQPHPRQPAVHGRRPGMPAGGDPDLRPAGADPAGQPQGTRPVRRRAARRRTAPAPGRTRPSEPRRWRPPNAGNPGSHRVPRPPGTRPAPRPGAPAAGRKRNRHRLAGEPDRPERRTRCRAPARHPPALPLP

SEQ ID NO: 31957 - protein, 345 aa, Pseudomonas aeruginosa
LILKRAHWKNQPITPGNLPRSCDPLRISANGSTSSETMIDIDRLSKRFSGRTVVNDLSFRIDRGEIVGLLGPNGAGKSTTLKMLSGFLAPSAGSVRIFGFDMQDKARQAQKLIGYLPENAPSYGEMTVEGFLAFVASIRDYSGREKRRRIDSAMDCMELRDERRSIIETLSKGFKRRVALAQAILHDPELLLLDEPTDGLDPNQKHQVRQLVKNLSESKIVVISTHILEEVSFMCSRALVINGGRLLADNTPGELRTRSRYHHAVSLSIEAPVDPLAIAMLPGVAGIEGRPDRAGTLTILARPGVQILPALNRLIHGSGWRVSGVRTEHGQLEEVFRQLTRETPA

SEQ ID NO: 31958 - protein, 366 aa, Pseudomonas aeruginosa
NWPIRSCCRHCSPCSSCCIGAGAACAGGGADMRLRNVAGLALALALFAGILGWLHERQQPPAQPPASRAWLPGLKPHQVTALCIATPGQPTIRARRDGKDWTLASKDGYPASGETIRQLLRSLADARLLEEKSASPENRERMGLSDQGKGQASRITLERGDAPPLVLLLGKRTSQGGQLVRQADDERAWLIDRTVGLPVNDLALLDPRLTDLPFEQLRELTLSYGNGVRLNISRASEKDDGIRLRQFPSRPQLMGEAEAEQAARLFAALRLLEVAPAKASRQKPLLTFTLKSFAGGTLQGQLLELERQYWLQLTDSKGFADGQVSAVKGWRYRVEGLSPDTAPAPQLPKASPVKKSKPAKPSSPKC

SEQ ID NO: 31959 - protein, 426 aa, Pseudomonas aeruginosa
SGGPDGGTRDDRGNPMGKLNPKQVENLTEPGTYEDGDGLRLVVKPTGRKSWLLRYQLAGRRREMGLGSFPEVSLKKARLEASAKRSLLSNGIDPLAARDIERAAQREAQKASEAKQLKFEAIAKDYCDAHSASWSDKWRKGWLRKLELYAFEHIGRLPADEIDTPQVLKVLQPIWQTKTRTADEVRGQIEQILDAAKARGLRQGENPARWRGHLDNLLSRAEKKKARKREHFEALRWQDVPALMVKLRANTAPASLAAQLLIMTGARAHMVRFARWDEFDLNAATWSLPEERMKMRVAFVIPLPDQVVELVQSIPRESGSPFLFPGQGKTGVMHANAIRTLLHEMEYKHITRHGFRSSFRDWAGESTNYPREVCEMALAHDERDQTEGAYSRSDFLDKRRALMNDWAKFLLSNKDTLQQREVNNAF

SEQ ID NO: 31960 - protein, 112 aa, Pseudomonas aeruginosa
GNHMYNLCPNCNSSRVTTKNLGKQTGGLIGAAGGAASGAAGAMSGAEVGAVLGVVGGPVGIAIGSIAGALIGGLLGGVAGGITGATIGEQVDEKILNNYQCLHCGYSFSIKS

SEQ ID NO: 31961 - protein, 335 aa, Pseudomonas aeruginosa
NGLISAHSSGTSHMAHFIEQMAYIGVTPWHGLGRRLSPKQPIEVWQREAGMDWKIQDSPVHFKSNSIGALGSIYTFPEQKVLYRSDTKTPLSVVSSRYQVVQPREVLEFYRDLTEVSGYELETAGVLKGGRKFWALARTGQSTVLKDNDQVDSYLLLATSCDGTLATTATPTTVRVVCNNTLAIALDGSNRAIKVPHNTRFDSQAVKKQLGIAVSQWDEFMYRMRALTERKVQWHEAMGFFMNVLCDVAPDDKLPEALPNERALRRVQGLYEGGGRGALLKSAQGTAWGLLNAVTEYVDHERRARSIEYRMDSAWFGNGAQIKQRALDAALRLAA

SEQ ID NO: 31962 - protein, 61 aa, Pseudomonas aeruginosa
QVPNQSPQSRLPLQPGQAVVEQRYLPALPRAISLHASETNQETHVIEAFLEPLYNVGTCNG

SEQ ID NO: 31963 - protein, 328 aa, Pseudomonas aeruginosa
ETGSRQTPNPLRTPNRMNTHKHARLTFARRLEMVKQMTLEGLDAVRAAAAHGVTAPTARKWLGRYLAGGQAALADASSRPLRSPRAIDAGKALLIVELRKRRMLQARIARSVGVSESTVSRVLARAGMSRLSDLEPVEAVVRYEHEAPGDLLHIDTKKLGRIVRPSHRVTGNRRDSVDGAGWETLFVAIDDHARLAFTAMHPDEKTAQAVLFLRNAVAYYARLGITVQRLLTDNGAAFRSREFRSTCVELGIKHNFTRPYRPQTNGKAERFIQFTVARVGLRLDLPKLSPSNRCPGKLGNTTTTGIARTAASAASRLCPDSTRQEITS

SEQ ID NO: 31964 - protein, 383 aa, Pseudomonas aeruginosa
SPSPYLRLTADDIREAANIGTRNVDIVFGGAPCQGFSLIGQRALDDPRNSLVKDFVRIVVGLDSSYFVFENVKGITVGKHKQFLAELIEEFQGKGYNVLPWKVLNAANYGVPQERERLILIGGKRGLTLPEYPAPVTRSPRSNLLMDSELPNGPTCQDALGDIPDAEAYEELMEADSAVVQWGKPSSYAKVLRDLVSGSNFYGYKRSWDKNLLTCSLRTNHSELSRTRFASTEMGQIEPTSRFFKLHANGVSNTLRAGTDSARGAFTSPRPIHYKYPRCITVREMLRLHGFPDWFRTHVTKWHGARQVGNAVPPPLARAVAASVIEAIGWEPASPDDTLLLGDEKLLSMDMGQASRYFEINVPIKQRDRKGSPKPKQAMLNLA

SEQ ID NO: 31965 - protein, 74 aa, Pseudomonas aeruginosa
AKALHRKVGGRLRRAKIFVKAVESSLYAMNEFKNGTISCPLDTSNPKIFQPLRPNSRCAFSSYDIFHEVVRITV

SEQ ID NO: 31966 - protein, 93 aa, Pseudomonas aeruginosa
SLTVCPIANSAGWRLMMDAKAHAPMRVLRLRQVQERIGLSRSTIYDRMNVDSPRYDSTFPKPMKIGCSAVGWLEESVNDWIRSKMDGAHRGKD

SEQ ID NO: 31967 - protein, 808 aa, Pseudomonas aeruginosa
FGGRDTFALVDDPAAQPVAFEADAQADDGPRRAVLDRILQQVEQRAREQAGVGPDHRFLLVVPVAPQVDVFLLREGPELVGGVHRQHGEHARFEAVGVGFGLGQLHEGVGQAQGATDLLLYLSVDLLAGFVLGGADVEQGEDRRVRRAQVMGEEAQEGGALALGIAFGAQVDQAHQPADGGFAFDRQQARQVEAQVAFPVVAELDGFQGFQRWAGATGEARMAEFGQALAQFGAAQLAAEQVACLAVGQQDLPLRVADQGRHRQAFQAVGHEPPAVAGAADRLLQGGDAVLQWIVAGARGAGPLGQHLGLAVEARQFPAEVGEHRVQPAPAPDQVGQQQADQAGQRRPPPAVEQQRPGKTQGQGRAGQGEEQGVARAEQHQAEQQRYAGGGEQGGEPGLQVDGGALLQQAVENVGLDLHPRRGAEAGRQRGDIAVAEARRGGADQDQAVAQQAVWHLAAQHADVGHAGEARVGTDEGNADGVVTLPAGQVAHVVEAGHGHGAGIGECLPGEQRARLAERSFAQVDAAHRAVAVRFDVDMPDAGGAAGQRRGRRYLPWRFAVARHAFAQQWQEDVAGPAQRSCQLAVAVRIGGGFAEDHVEQYAACAGGGQAIQQLGVDAARPGPATEAFQATVVDGDDEDARIDGQRGEVAQAVVEQVVQRQAAAQRKQGGERKEQQADQQPFAHQAAEQPLRLAGLVLAVERLHRRGPGALSGTAASRVVENVVYAGLALQSVVVEGRETDVVEGRLESAETDFRGARETLLLDAQEVRIAGYLGTVALGAVQRGKIELPNRRLAVLAALAAQLRGG

SEQ ID NO: 31968 - protein, 542 aa, Pseudomonas aeruginosa
QVHRRQLALRLDLQAAAGVDQHVLVRLGLRRLAGRAPAVERQVVAGQLAVHRDAPVEHFGQRLAVFGAGAEVGTAHAQYADRGQHLEAVVIALSLQDIGLDLPRAQGDLRNAGVLVEVQGDFRTGGQDDAAAVAEQQADEGGRRGLDAFQFVDVHAFFQGRLVALGVELPGVAGEVEHAGGERLGQARFALLDERRPFRLGRRGRDGAGEQRQQSAQRQGGASRKEGSGSKGEGCHRLHWAAGQVSLAVRSGCNLPDRAPVSQSLQRHREPAGSLVVSSAAAPGGWARRFGSVVLVADQAIGQGAEYRTENRRDPEQPQLGNRPVADVQGDRGAARRVHRGVGDRDADQVDQGQGQADGDRREALRRALGGGAEDDQQEHAGKYHFADQRGLQRVAARRVFAVAVGGEAGGQVEAGLAAGDQVQHAAGGEATEDLGDDIGQQLAGREAPADPQAYRYRGVQVGAGDRADGIGHGQHAEAERQGHAEVADSQFRYAGSEYCAAAAAQYQPEGAEELCSVLLHDEVLFRSRMGRGSRRPDSGRG

SEQ ID NO: 31969 - protein, 243 aa, Pseudomonas aeruginosa
TGPAFMRVAILDDESAELDRVEQTLQQIPAQGEQAWTVHRFARGEDLLKQLKRETFDLLILDWQLPDLSGLQLLRWSREHLDAPPPAIMLTSRDAEQDIVQALNSGADDYVSKPFRPNELKARVAAVLRRHGGTRPAQHEVQTFNDLSFDDAELTVTRAGAPISLTEREYRLARCLFANLGRPLSREYLYERFWPHEEVLSSRPLDTHIYRLRNKLGLTAERGWQLLTIYGYGYRLESVATVD

SEQ ID NO: 31970 - protein, 167 aa, Pseudomonas aeruginosa
ASQPPPPTTPGQARTTGPCRDVSPLRSSSNSWTTPLASRCFCGLTKSSGYSTSSWKPWYQFSSGRCNSGSCACAASSRRPKSSRSTPASAVRCLSARNSTARSRRRRSSSASRPSRIGRCRRTRCQSSSATGWRASRRRRRQARNDHMLSRSGPWPVWRRSPAGDGE

SEQ ID NO: 31971 - protein, 365 aa, Pseudomonas aeruginosa
PRWPASPCCWRPSRCSKWPTCAPSESVVRGWPRGAWRACCSRCCMRRGRWRWSCRGRSSAPRRRHGIPAGQRWARRAPATAWMAGPCRQLARSARPGGYSAPATSKDARRCCCSRRSMPTKRSGSANGHCGAAVRRACREYCRRPGCVVMPSSCSLRRAGRCAACWIGRQRTCRWNRNARWSSWSNLWMRFAPCSGAAYRACGWAPRQILLDEGGRLLFLPEAAAILPGVARQALPADSVPLAPELRRGEALDGRADQFALAALFYWLLCGRWPSIACPESDGGCRYEPLGERQADLPVGWDGVLARALAPRPEARFEALSEFWLALQKPLAHPQRVFAPRRLQRGVLALVLLLAGAALLVGLAG

SEQ ID NO: 31972 - protein, 80 aa, Pseudomonas aeruginosa
RASHCGKGLPGRCRLHASNASMLPNLPGKRNPSERLNRPKEGRRAPAHPSAGRLSPSPGGSCRCAEPRRPAPGPPPRPSG

SEQ ID NO: 31973 - protein, 535 aa, Pseudomonas aeruginosa
VSPPTLWVKRAMCVSSARPRHAAGRALSLSLSAQVLFRRLDRGELFFRGAGHQVMPTVQGEVADQYSVDRHRADHDPRVDQEAGDHRDAGQRQGYAGGEDAARGAVGALHVRAADAQGDVRGHHQHVGDGRAEHRDQDQQVALAGQRQAEADHPRHHQGQYRRLLAVGQREAARQVAGAGEGEDLPRVGIDDREEAGDQPGQADQVDELAHPGRTLVGRLQRFHQGIARAHQLLGSGGPGTDDQNQCGEGEKHQHGADQSARQVALGVLGFLGGQRHAFDGEEEPDRVGDRRPDPDIAERQEAAGAGRRGLRDVEQVGRVEVRNHRDNEHAEGDGRHRGDDEHQLQRLAGAEDVDADEYDVEHQVDQPAADAEQRLAVGADEAGDGRRGDGVFDEDRGAGEEAAPGPEGAAGEAVSAAGGRDHRRQLGEREAHAQVHGGHQQGGEEHPAPAALGQAEVPAGVVAGDHVGDAEPDQQDPAGGAFLQLTVLEVVGVDAFEVDPGSCGRMAGLFEGHGFFTSILLLSTPVFPVVCCTW

SEQ ID NO: 31974 - protein, 878 aa, Pseudomonas aeruginosa
SRRGPSSGLPFLDPHSKREPDHDNKNLTRPCRPPAPEPALPRLRRRPGQRWRRAGQGCDLGGHRQRRQDHRRRAAVRHGHPRPALEPAQAGQRRQRVQADPGLVVLLRRRETARPGVPGHRQRRRDLRDRLLLAAVRPRCEDRQAPVDLQPPPARRHPPVLRRGQPRRRDLWRQGVLRHPRRLGGGAEQEHRQGGVEEEVRRSRRRLHHDWRADHREGRQDRQGPADPRQFGRRVRRGRPPVRPRSGYRRGNLDASLRRRPHGPPERQGQHGDRRRQGALLAGRSQLADRQGRVVEPRRRRSLAERQLRRRDQHHHRRRRQPRPVEHLGAHRQGRQSARLRQPLHLRPGRGGPEQRRGEVVLPAHPQRRLGLLRQQRTGAVRLQGQGRQDRQGHRPRRPQRLLLCGRPQQRQVAERLPLRRQHHLGQPHRPEDRPPGGARGPAPAAAGTGAEAWQGGGSIAAVPRRQELEPDGLQPGHRPVLRAGQPLEGRLLDRGGQLYEGQRLPWHGLPDQAHVRRPRRQPARHGPGQRQGGLGTQGTPAALGRGAGHRRQPGVHRHRRRLLQGLRREERQGAVEIPDRQRHRLATDHLGTGRRAVPRRDRRLRRRRAAVGRRHGRPDPAGGPGRFLLGIQAAQLGQPHRQPLIPAPRPARRGFPRLRSIPMKTFLLCAALLGAGLAQAADDIDDVRVIAGCRLEPGARCAKADLRGADLRNLDLGRIDLAGADLSGADLRHARLDLANLEKANLRGADLTRASLQQANLRGADLSGARAVAIQAWGLFAQGAQWQGADLTAAYLEFARLSGGRLHQATLRAADLEMTWLSRADLKGADLRDANLQEVKLAEANLEDADLRGSKVRFGNFQGSNMQGCKDCPAGWQ

SEQ ID NO: 31975 - protein, 245 aa, Pseudomonas aeruginosa
AHSHPPACPEPPPAAHNDNNEVQAMYKILIADDHPLFREAIHNVIADGFPGSEVMETADLDSALGLTQEHDDLDLILLDLNMPGMHGLNGLMNLRNEAPTIPVVIVSAEQDKQVVLQAITYGAVGFITKSSPRAQMTEAIEQILNGNVYLPSDVIRTQKSSPRRSGHEEHGISPELLQALTRKQLLVLERMTKGESNKQIAYNLDIAETTVKAHVSAILRKLKVHNRVQAILSAGDIDFAAYLRR

SEQ ID NO: 31976 - protein, 290 aa, Pseudomonas aeruginosa
DPPMPDRRTLLLTVLAMLAFAGNSLLCRAALKDTAIDAVSFTALRLFSGALMLAILLHLRRGPATPARGGWRGAAALFVYAAAFSYAYVQLDAGTGALLLFGAVQVTLLLAGLLRGERLGGQALLGFLLALGGLLFLLLPGASAPPLGGALLMLLSGLAWGLYTLLGRGGGDPLAVSAGNFLRALAFAALLLLAFHGQLRLDGAGLAYALLSGALASGLGYAVWYSALPGLTAIQGASVQLSVPVLAALCGALLLGEPLAPRLPPATLAVLGGIALILAPRLGRAAREDA

SEQ ID NO: 31977 - protein, 290 aa, Pseudomonas aeruginosa
NDRAGRGGADYRNRESPAIRFLGPASTLLHGGRGCRCARRGQRSSGGSATLVAAGAPPKQRGFRPNAAVTPARLSSSYRVARFSADWKAPTSRRAPPATGPGPRAGRRRSGRGRPRRAAGSDRRHRQGAPPRRAVLARRSYPVLGAGRRRGLRAGRPGVAPAVARAPRRSAGGRSPYAPAGVPGRHAEIARRTAGRAGRRPRGSRRTTRSPVAARRAGAAGRPVRAGAPASARPPPSAPPAWAADRTAATPTRRPWPVRGDAVRASAAEAPGARRQPGRASIGDLASRPA

SEQ ID NO: 31978 - protein, 472 aa, Pseudomonas aeruginosa
PRRPSASAASRRPPPAARRVGRARRPATAGSAGQWRCGAARRRTDARRSRASRAAPRGAGPGPGARRPRGDRADRAGSATSPRRAPPGPSPHPPGVPGRTADATPGAAPESVTVRAHRESASAGTARPRRRHWAATAVRSARHAAARPAAALRQPAPHSGGSPPTSALRHRRVRCPGAAAGNGRRAARPGRPGESPLAGQERAGVVAPAVQWAPPATAGAPPAGWRHRRAGRPASRKRPPPAPPPRCRRTVRRSTPGAPAAHPGEPPAAPPIRPGPVRRVPPATRPASDRRAIRRTPAGSVRRPPAKRRGQSPAPAAAVPAGAAPALRRRRAATAAAADSRLARAPAGRRRHAAPASPARPVPAALAAIAGNCRRDSGRHGIRAGPAGTHRSPGPGCRGARQRNAAGGCPAGKPRASAASIRVCSSAERARYSASSTSRSRRCASMSSKGRASMSISRARPAPMCSAVTSKK

SEQ ID NO: 31979 - protein, 615 aa, Pseudomonas aeruginosa
  UNSURE (282),(286): Identity of amino acid at the above locations are unknown.
SFRRVVSGSRRLLARRFLGVQRPSAVGLERLQDLRRTARGEQVEAGIVGAGAHFQQAEHRVEQVVLGQLLVAALAQAATVEAEGALVAGREPGQHADVLLLVRRQQVRRAMQVEVVLAERLAMVGEVEHAGIDALFVLAQQVDQAGQHVVGVQQGVVVAVDDAVPRAGAEVVAGADRGELLVLPGIALEVGRAVAAHLVQDQHGVLLQPVDEGLQVAQEDLVMALAAGAQGRILALAQVLEGDAVAGALAAGLVVPPQDPQACALQHIEKAFLGARASVAVXRAAXVGEHAGHRHRGLGTAGVHVGEVDQAFFGLQPRVGLASVAVEAEVLCPRALAHHQHGQRLARMALPQGGAPGIDGDRPQRLAGGLGLALGVADGGADQVARGDLQAQFLVVAEQRGQPLVIGQRHPGKQGQAGERHQQLAQQLAWPRPVAHRRAPQQPDRQRAKQRQVDGELRRKQVGDLGRVGLHDVAQHADVHQHAVLGHEVGGTGGRQDQQGQRRLEQPAERQQGQRQVEDRGDHQADCQHHAEALPARRGDRQQALPQRQVVEQQEGEADQQGQQFGTDGAGFRHGHGSSLTSGLPCAALPLAALDDGGSLLGNPSIFREEYLQKT

SEQ ID NO: 31980 - protein, 500 aa, Pseudomonas aeruginosa
ISSSSAVPLQHERFERPGHPGAWFYDLCPVRRGRQHHLPAHRRLAVRPPCVAGGAGLPDHRGGAAGDHRDRPGQGRRFGRRPQPSDRQVCRRPAGGGLLPGGRPAVRHSAHRHGVLRGRRGAAARRERHGAVRLQPGVLPPRPGHLPLPRSPAGHRRTLPRPAEDPRPGDSRRRRLPLARRPDRHGPAGVHPGRVLPGFRQRLPDHGHPRRAGLRHRHRQRHPFPRRAVAAADHPLCHRRRADRRCRPSAGLRQPVPARRRQPCHRRRRQQRRGGPACLRATYLRQPRQLVPGGTYRAGLPGHRGRPDLRLRRVLLPAPAAVLPQPGDHPGRVLLHRFQPRPDQADPGLDPGAHRDLSAVHRAGGAELLHRPLAFGDAHPRPGDAGFPGVRRARCPEGGGPGPGLPAMAAAPAVGRTGPGLVDPLGRHSRRLQPGRPPAGQACASRRLSRPQRPAACSPGRARDMPAGGANRVVHPTARLAPPAALLPAFSRTNKHYRAG

SEQ ID NO: 31981 - protein, 214 aa, Pseudomonas aeruginosa
PRNAVAVRGKRLPPPRPAPCAEPSGAGFGDLARPLRRSGGHSFPWKQVMNSIGPASLSGWSARYLNNQRQANTEIGNGDLLKPRPALGTPLRNEAVDPAAESARQAMDEGFAKLNLTLKQNQANAPAGASEGKSAYDEFKEYMQKSPAERMREQVLKSLGLTEEELDAMPPEKREQVEKGIGERMREMIAMQNGQAPGRQEDPTQARATLNAWI

SEQ ID NO: 31982 - protein, 330 aa, Pseudomonas aeruginosa
STFSWKPCNAPRARPARPTAAPASEPRRSADPLQQRGGQAPAEQAVEPEQLVQQDDAPEHQLERELAGLVAEYLLRDQRARPAAEQLEQVQADLRGTPVAACGAALVPPVEGECEQAGQRIGQQRPEGLSVQVHPPGASGRQHAEDQQDQQLRQRALQRARRSRRRPRLGPRHRRLGATADSWRIDGQRVQPRPLGAQAALGVLAGEKPHLVALAGTAVAAERGDMQEDFFPAGLRQDEAEALVVIPAADHARLFHIHIHSLATRFALHSSHPRRPDEKRRGSRRASCLFPGLTPRRRCSSRSGGIARSPGSAGRRRSDTRRKPRSCGCR

SEQ ID NO: 31983 - protein, 173 aa, Pseudomonas aeruginosa
LGLSANEGSAIMSGSSLRIVVPALLVIVGSVPVSLPAHAADGTIVVQRQVQPRVAYRPSMVPDPHPTVVDTNVSAEVDALANGAASGNTVSRELGDADFAIVTSGSGIRSMILPGGALPGFASQPANPATVQAVGNLGTTHGAGGGAGAGLAGQINGSLKQGLAPLQMLGGGQ

SEQ ID NO: 31984 - protein, 279 aa, Pseudomonas aeruginosa
TSPPVAATSRATPCPSPPVAAAARPVARALASDPGPGVPAPAGTLFHPTQEPAMRTLILSLLLLVDLTAQAATLGFPALPGGGLVYKQVQSIRERRFADLVEQKTDFSCGAAALATILEKAYGAPLDEQAVIQGMLAHADPEIVRTQGFSMLDMKRYVESMGMRARGYRIEAAQLEQLKIPAIVLMEIRGYKHFVVLQRTQGEYVYVGDPALGHKRYALTEFAKGWNGIVFAVIGQGYDRGNPLLTPPEPLTARNRLDRFKPVRDAELMEFGFIQSDFF

SEQ ID NO: 31985 - protein, 260 aa, Pseudomonas aeruginosa
  UNSURE (102),(104): Identity of amino acid at the above locations are unknown.
SQEPDAPGARHVHAPLLRPRLLPGRCAARPRQRPLRPRRTERPGAFPVARALRAAGADRQLRGDHEQHLAERQRPGPRRARRPAGAAEPGAPGPQRHPGRSXRXRPTTRRRQRPGPRRRRTGTDPRGQPEHPHRRRPQQRQQWRQHRGPPRRRAAATAGRHAAGRCARPQRRGRHGQGHAERRRPATGDPGQRPGRQPAKPRRRRPGAERGAQRKPQPGAEPGGARGDAQGPAGRRSGTELRLGAIARAAPQRLLKVDLV

SEQ ID NO: 31986 - protein, 451 aa, Pseudomonas aeruginosa
KRNGKHDPDTLAASCPLRHHPGFPVPGAGRDGVRGRGAEEGTPGAAPTLRGPAERPDGPRTARAPGRGATPGAAAATPGQVDPAAGAGAQRRQRGRRHLRRQPQGRWRARAQRGKHLPGRQRLLRRRHLQPGDRPHLQPLRHPPVVPQRLPGAGLDLPRQHRRGPDRCRHLDPRPDRPLQLEPALAGGYQRPGGLSRIDLPVRRRRRLDLADHREIGDRRPTPGRRQLRRRLQVPRRKREHPGRGGQPAGQGAHRQGSLRHQAEAGTGQQQPQRARRPAHRQRRLVDHPGHLAGEDGGPGGAVRQPVVYLQLRRVVRRHQPAARREDRRQGQARQLVPTRRRRGLRAEREDEHVVLLLRTDQPEEQGQAGRPKLADRQRQRRQRRLLRPGHDLCGEQQVQHRAQPVHRHHSGRAGLHLRREIPLLLLRGHRSSLGMPYPSKGCVSLGAILA

SEQ ID NO: 31987 - protein, 133 aa, Pseudomonas aeruginosa
QRHRPSQASPASARSTSSREGIEVCAPRRVTEIAAAAWPKRIAAASSRPRARAAAKPPTKVSPAAVVSSALTRATGKCSTRPSPTSRAPWAPRVTITLPAPISRRRSAARPALSRESTGRRQSSSLSVSLGTR

SEQ ID NO: 31988 - protein, 159 aa, Pseudomonas aeruginosa
ASSPRQPIIATPAPRRAAATAWLAPLPPGMVVKDCPARVSPPRGRRGARTTRSMFRLPTTSTFACIVASLFQPLSSEGAPGARFRPAPAAARWIRAGPAPAPPPAAASAPRARRCVAAAVARRSRRAGGSTGPRWSRRETRSGSARYRRSRSPTVRAAP

SEQ ID NO: 31989 - protein, 157 aa, Pseudomonas aeruginosa
TRFPAATAGAPPGRPWPSPAGSPRPAASKPWSTAARRCRRCRDGPARAGGGSPGRRPSHGRSAPGRLPRLPPRGRRSRSACACSPAPWPARRRRRRTPGPGRRCVSPGARAGSWPASAGCRRSCRGSRSSRCARSNPRCPATARRNTGWCCSAPAGR

SEQ ID NO: 31990 - protein, 879 aa, Pseudomonas aeruginosa
RKTSGRSFLVPCVACSRRRQQRVAFLVTGEGRRQQRVLGPGVALEGVHHTSRREHADAIADQHQLAQVAGHHHQRLAPAGQFGEQGIDVELGADVDATGRLVEQQHLAVALQPAADHHLLLVAAGQFAHRLRGVRAAHPQRLHLAPRQGFLAAPVDHPVARQRRQVAQGQVGADRLVQQQALALAVLGDQRHPLAHRVGRRTQAQALRRIAEQDLPTVGAVGAVDQAQQFGAPGADQSGNAEDLPRAHLERHLMHLAAPAQPLHPQQRRTGLPWAQVEALAQFAADHQGHQLVGVVALDRLDADQAAIAQHRDALRNPRQLFQAMGDVDDRHAAFAQPLDLLEEHVHLARGKHRRGFVEDQQAAVADQVAGDLDHLLVADAEVADQRVGIDRLQADLGHRLAGRRAQAPTVDPAGAPGQVVEEQVLRHRQGRQQVQFLHHHAHAQRLGLAAASGGVRPAEELQAAGAGTFQAADDLRQGALAGTVLAGQGQHLAAEQLQVDLRQHRLRVGLADPADAQQRQCVARHGKAPSDGSGRSHQLDRRLDHAVLLMFRGLPGEQLERGLDTEHRLLRGELVGSGQHPAILEHRLDRLDIVVADHLHLPGAARRAHRRYRAEGHAVVAGEQRLEVRMLVEHRRSHRVALLDFPVARLQGDDLHPRRVHRIPEAGGALLGIGGRGDPFDDADLVAGLQSLRQVLADQPRTLAVVGPDEGHADLLRLQHLRVEAVVDVDHHDAGVQRFLHHRHQRLGIGRRDHQCVDPGNDHLLDDADLAGGIGLVLDAVGNQFEPVGMLLLVGLGAVLHGQEELVRQRLHHQRDPGLLGSFRVDGGQGQERGTGSQHNGSQQAPGSDPLHGVSSSFSYRCIEAFPGDYPDANVCVR

SEQ ID NO: 31991 - protein, 308 aa, Pseudomonas aeruginosa
RSSRNVPASIAASRSTWVAASTRTSTSTGRLPPTRSICCSWRKRNRLACNSSGRSPISSRNRVPPSAASIRPTLRWCAPVKAPFSWPNSSDWIRCSGIAPQLIATNGLSARRDCRCRVRATSSLPVPLSPRISTGESVGASFASSRRRSRTARLSPSSSCSPSASPGTVPRPRRRAMPKARPRVTCTRAMSNGKVWKSKNHSQTKSPTPFSGKVSGLSTAIHSVPLRLIRSFTVSGRSRWNGRRRSRPTSQARSRAVSSAQLSTAQPASRRPGNRRRQSSHGSTTSRRRRFDASNMCAPLRRQFFEPS

SEQ ID NO: 31992 - protein, 444 aa, Pseudomonas aeruginosa
DVQSSLRSTMMNSLLTTPPGVTAKPRRIRNRLAGARIPANTRRESLAKPLYGACQQTEAYSTHYSTPARKFPPAAVETAMNLTLRPAGVDDLSALVELENRCFDYDRLSRRNFQWMLTRAHASLTVAEGDGGVLGYALVLFHEGTSLARLYSIAIDPRARGIGLGQKLLEAAEQAARDNDRAYMRLEVRPDNRGAIALYERNGYRPFATVRDYYEDHSEALRFEKRIRNPGHEQRRHVPFYRQTTDFTCGPACLLMAMGALQPERQLTRREELRLWREATTIYMTAGHGGCSPQGLALAAWRRGFRVKLVLSAGGPLFLDGVRNEDKKAVMRLVHEDFCEELDASGVEQKRSARLDIPRQLARGGQPLVLISSYRLTRSKAPHWVLVTHYDEDFVYLHDPDVDHSQHRQPLDCQHIPVSHAEFDKMSRFGRSKLRAAVILFNPE

SEQ ID NO: 31993 - protein, 360 aa, Pseudomonas aeruginosa
QLANMPTPWHNGAQKRPTRTFLMRTVKKALLVVGVIVLAVVGVVVYYLANPNLPHYQAPSEVRYLPQWQDEARQRFYYTPQGTLVKGLHYDWFTALELPFSEEPFAAPEYLARFGFLVDPQQKASDLNPGNLPVGFSQHRDEKTGTRYLDITCAACHTGELRYQGKSLRIDGGAAMHSIAATVPTLRGGAFGQALGASMAATYYNPFKFNRFARKVLGERYEQDKSQLRADFKAVLDTLLRTAWNDTRRHLYPTEEGPGRTDAFGRIANSVFGDAIDPGNYRVANAPVSYPQVWDIWKFDWVQWNGSAMQPMARNIGEALGVGARLQIFDEHGQPLQGEQRYASSVRLHDLHALEETCNN

SEQ ID NO: 31994 - protein, 420 aa, Pseudomonas aeruginosa
QPLSLQGGRLARGRGEAIVAHSPPKKNKSPQPTHTTKDTHSMRALLTHAWLFLGKWLGRLLLLLLAVGLGGWAIGSLYYAWKFSGPVSAEEQIAPDEARITQAIIQDAIRVVEQHRDNTRVLRDAHAKAHGCVKAEFKVRADLDPTLRRGVFAEAGKSWNAWVRFSNGNAYPQFDSKNDARGMAIKLLDVPGEKLLPGRGHDGEQDFVMFNQPVFFIRDIAEYRQNFAAQADGKKALAFFPNWNPASWELRHLLIALRTLAPAPDSPLHAGYNGISPYKLGEHNIKFRVVPAPEKCPAYELPKQNQDLPNFLRAALYQQLSIDRAPACYAFQVQRQDPGKYMPIEDTSVEWKESDAPFATIADIIVPAQDFDSREQNLFCDNLSFNPWHALPEHRPIGGINRLRKAVYEAVSGYRLGRNG

SEQ ID NO: 31995 - protein, 95 aa, Pseudomonas aeruginosa
SKSRAVPVTPAAKWSELAPPLLCTCLRRSTREAGKARQPLKLAADRNSRRRVEITSSNQGRSIVVGSESTKTYHNALIRPLCKRGKIYLLHSNSA

SEQ ID NO: 31996 - protein, 468 aa, Pseudomonas aeruginosa
KKDRGQHRGKDTMPNPVMDHFRLRPISESDIDQVVEDARGKRAHPDADRREQIGADYVLGNCVIELKALDDEGLAKPERQAKLAALFRPFNADRPVVVLDRGSLPPPEQRNYDRILEGPIKTAISKAKKQLKQSRLEHEGTTTSIIWFVNNGYTALDHDALLTLIAHRVRNDTNEIDGIIVSGCYFHSDSFDSFFLWPFEYVPINLDKDFPEFDDLHRAWNDLATRSMTALMQKFPGKQEIKGPVVDTQFDIDNITYVKPAPPIGGKSDFFRHGRPRLNSTGITTSPPVGLVFGDLSLGQWTTFRENLPNAQWLRKNYEDWKLKRADAAKQATNRQVFISIPVTWDAWLKWNEESGGNRRLTTHHYATHVFQEKISELLNEAKDIDGVGILPNRYMLIVTEEIGQDKCNDISHAAIVIENPDGTQDFEEIFFNQRLFHEYAMTLGCAHAIARGIGVVRWRKNKTYAWR

SEQ ID NO: 31997 - protein, 1102 aa, Pseudomonas aeruginosa
MISDSRRNLRKLFPRTRKPPRLPCGFRCATATRLLAPVAQPDQRCAVHRVVLGGEDRLAFDGGPRLEGLGGEFLVHGIQPEGLAGGGLRHQAAVLQADLALRRIHQADLEGLGAEVLVADGYAALVALAGEDHHCVRRGGEAEGRSGQQAGQGQGHCVLHTDFLWQRLNDPVIFRGSFRRDQAQCQGMRGASCSASRRVSSGTFPATVLPGENRSLRGTPVFQPTRSSRPPGCPRTLATTGRTLGPGRWPNGRRACPLPAWPRCNKCAWTGIAVALGEGATEAVGGMSCSTPLRVASGACDLPLGESPARRPGRWPPSRLRRLPGSAEQLVDGQREVAQAAAGGVVHGIRHCGGDADDAYFADALGAQFVNDIVGFVNEDHLDIANIGVNRDVVLGEVVVHAAAQRMVDLGFLLQGHAQAPDHPAEYLAASGLRVDHPPRRDRADHPAHTQGTEGFVDPHLDEYRRMGRGGVAFAPRRGFSFHLHLQRVFRQPLQQVGQGVSRIARFQMATAYAEAFFGGAGQLRMAGPGMGDQGLAQAQAGQADGGTDRRDGERAALQWSLGQRTVAKLEAHLFRRHASGVGGDLGHHRVGAGADIRGRAGHPQQAVRLQPRPRAGLALHGLPDAAGHAPAEQLAPFAHAPWPWVAGLPTEAPGALLVAGQQRLAGVRLVLVAVALGEVEPAQRDGVHAEPHRQFVHRAFQPDQPQRRAGGAHVQRGIDVQRHQTVGQGKVLAAIEHAAPLHHVLGEVFEARGLRCRLVAQRKEAPLGIGAQLKALQGARPVAEGEHLLAGQHYAHRPPQLQRRHHRQGQLVLRTQAGAEGAADVGGTDPYLVGGQAEDLLQVGLAVLRPLGLVVHQQAAVGLDDDRGRVRFHGIVVLDRRAVAGLDPNRRGAVGGVEIAALGGQFGGSLMGLVEGGQQVGLVRLGLDVDAQQRARVAGQFQAPCQDQGKGLAAVQDAVVEQRAEGFAFGGIGVLVGLVVARHRRPVQVMQYRDHPGYRQGRRTVDAAHPAAGDVAADHAAVEQVGGRIFGGVASLAGDLGWPVDAIQGLPGAVWQAAHWPIPPEWASSSARTMALRANPILKALWASGLASRSSASAKRT

SEQ ID NO: 31998 - protein, 268 aa, Pseudomonas aeruginosa
SAGPPAPDWSWYKPHGRCIGAADAAFSGPTERLEDTFKVNDGHGHATKAGGCSTPAPLSAAGALRRGHLNRLDTTRATCSAPLLISCMMPATVVIWLLFSWALDSMVCMLWLICWVSLTFSVTTFLISTVAPLVRAASCRTSSATTAKPRPMSPARAASMAALRASRLVCSATLWMVVTMFSMSLVWWVSWEIRPTAVLTIDRVLADRATDWSRESMPRVEICAVSSAVENDSSAARRTSSLRLTCSVTSMANLMTLIIRPELSLTGL

SEQ ID NO: 31999 - protein, 573 aa, Pseudomonas aeruginosa
RSPGSGKTMCYGRWWTLRAEPTCKCGTGRQASRSAHQARRSTAGEVATQFAGGGDHVHQRCLGFRPGAGLQAAVRVDPEPLGGYPPGRLAQQRDDLFPARHARRMDVVDARTDLVRVVELLEGLQQLHVRTRSLDGDHVGVHGGDGLDHIVELAVAHVRMDLGFVADSGGAQAEGLGGPLQIVRPGVAAQRQAFAESRLVDLHDPDAGGLQVDHFVADRQGQLARLHLARHVLAREGPHQHGHRAGQHALHHLVGKALGVPDPLHGHGPRTAQVAIDHRRLHAARAVALHPAEAGEDVAVQLLGEVLDHVVALGLAVHQHVQPQLLLDLHRMADLAVHRLDVLGLAQLALLERLAGQADRRGLREGADGGGRERRQVESGALPGDAFGERRAALGVAGLDRGQARLHGRLVDSRRRSAAGLDRTALFQGGKHLGGLRLSGGTGQHRDFAALLHGEGQPALQLGVQPVFALQVHRAVQQRAGRRDPQPLAQALPGMAYHFQGFLQVAAPDVASVDQAQRDDLVGRQAVEDARILFRRSHQVDVQAVHREVGGQAQVVFQAAEVGGDQLLQRFAL

SEQ ID NO: 32000 - protein, 251 aa, Pseudomonas aeruginosa
QVVGALEGVLPCLRQVEDQDRLVDLHPLHALAGEAAQDLAVERQQAVQQVEPVELGALALAQPQVGQRTDQHRLHLVAEGPGLVDLLEQLFPAQLELLIGAELGDQVVIVGVEPLGHFLGMGTAATTVVADATGHAEQGMQGRPGLAVRPEALGDHAEGQRMGQHLVIPGEIADRQQLDAGILLYLPVGSAQLPTDGPQAGLVQLALPERFLGFFQFAIASDAWEAESVGQGHGCSSSRKVDGGILGRLMP

SEQ ID NO: 32001 - protein, 820 aa, Pseudomonas aeruginosa
DKLNFFVMKSSFPHDHPRALTSAPSSLALADRHAPRLETASRGSAGLAVDQGLHPGSRRVQLLVAVDQPQVPVEPFQLHAGRRQAEEAHAAVHRAQRGIHPRVAEHAAEIGLVVGDLQLVVEDDLQHHVQRLVEQAALDAVVVVLEERLHAFLGVFEALQGEADEHFQLEDGQLAPDRVVVELDADQRGDVGVVVHLAVFQALQQRPERGVVEAVQVEDVLAERQGLVGVVPDQVFHRIDFRVARHQDPAGRSAEVLVHRHVDLLAHGFEDAEQGRGFLGVGSLALPGEVPLDEREIGLGAEEAPGHHAAGIDEMLDEVVRLGQRMAFEGRLGQVVQAFEAAPLEQFGQAALQGHLEARVSAEGSEHAAGARIHQGHAHHREFAAQRGVLDQYREALLFQAADPGEDARVLGQHLRRHVRQRQLAFEDLPLDRTLEDLRQALHLRLGQGIAGAHAVAEVEVLDQVGGEIHHLAVGLAHEGQGADTALHVARVGVVQVRAAQLAVGVVDRQAMAVEQSQRQRIVAAGLEPAFVRVMDERRIGDLFSPVLVVVEEVAVQPLDEFAQRRGQRAFLARALAVGEAHRRLRIADVQRPDVGHDVAPGGDLDLHAEAGEDGRQVGDGLLQRQVLARDARAAGGIGAGHQQRLGVGIEVVDLLDDELGPGLHHLLHRAAVDGAEDALAVLLRDVGRQFHLDLEDLPVAVLRVDDVVLRQAYVVGGDVARLAVQLDEVGGTQRRRRQEVVERPRRGAVALVADRLVGDHREIIEPGFQSKVIEKIDLYFHGEHQEKRKPAIIRELRAKVPALRRTRRYLPASPPLSGT

SEQ ID NO: 32002 - protein, 497 aa, Pseudomonas aeruginosa
PFLGAMGAEMDQRVGAETLADELVDRQVEMVRRHRAVVVGLARTAGTRRLRQQQQITQARRREHEASLAVDIAQGPMSTRVAPARAHLLAQVRRQRLEPVQVGVQRQARGEAVAIQRVQGLRPVVAAEQALGGIDQRAFVARRNPVAGRPQRFAETGQAGRYIEMRGGDVLLALRVVPEHQRQVLVRHRQATQAQQPVELVQQGLGLPGHQLRLAVLQGADDQRIAHSPGFRHAEEGRHGTRRHPAGGGQPVGLVAVAVAEGLQYRHVQREELGTARRAVLQVLQVDQRLDIGASEGLPQRLRIAVVEPHRQRRLAVPLATPQQFVDGAGLGVGDGAARDQEGDARGIAGPARGAPGQVVGEAGERRRCVGMIEAGLRQGLRRRQRVDGQAGMPALDRLEQPAQVGFAAVRVVADQAPAQRRRQVAEARRTAADADPGLRPALQALAQRLLDLGAIGRPRRVEDQQVAAVQPLAGRRLADAEAQAAQLDTGLARPTG

SEQ ID NO: 32003 - protein, 85 aa, Pseudomonas aeruginosa
TACRGGSRPVRRSTWAAPWGRWSTSSAPCRTNGPGPRPSAPSIPTWRPTCARTASTTPACARPSRSSSTTSTCRRAGAPRRPSPT

SEQ ID NO: 32004 - protein, 147 aa, Pseudomonas aeruginosa
TACTRWCATSATTARDCTAKPGARWPWPCSITCARGWWVSRRTAGTSTTWKPRPPRAPPIASPARTASAIRASSRPARRRHPTTPTPRNCRWASPTTRSRRWSCRTPCNASTPAAPCCISTWPSGFPPPKPARPWCAPPSVASACRT

SEQ ID NO: 32005 - protein, 107 aa, Pseudomonas aeruginosa
PSPPPSRSARGTATWPASTSSARSATRSCCNAPRPRAVAAAAAVESPVVPFIHQQGVPPMNPNQLPEGQRQRCEVWTRVMGYHRPVAAFNAGKQSEHRERRHFRETR

SEQ ID NO: 32006 - protein, 720 aa, Pseudomonas aeruginosa
  UNSURE (488): Identity of amino acid at the above locations are unknown.
SRRAARRKSPGHACSTSSADARACCRRWSSAAARRPCRRPSATPCARSANWASASACTAPASTPAPSPGCWRRATGWASTSRRRPRTSPPLPAWTAAARPTGAAWNACWTAAWPTNAGPRCTGACSIANASGAWRRACARWAWSASPYNWRARPASSIRSFSRSPRRRALRSYGENWKSCFPPSNCATPEPPVQRRRSGLPARSDRAGSPNQACPSQDSYDRTRAPPRFLVASNCRGRRRSPPLLQIQRPRTRAMKLTLTPPLTPSHWMRSTDLADAASAPLVGTHSADVAIVGGGFVGLWTAITLKQLEPDARVLLLEQDVCGGGASGRNGGFVMSWWPKIGTLLGFCSEAQARFLGESAERAIQELGEFCARHDIDAHFQQKGWLWTATTAHHLDAWNDTLAACERLGVSPFERLDASEVARRTGSPVHLAGVFERSNATVQPALLVQSMRRVALALGVEIHERCGVSQIVPGQPAQLLNAGARVXAKAVVLATNAWSAALPRLSRLIVPVNSSIAVTEAIPQRLERIGWTGGEAITDSQLMVDYYRTTRDGRIAFGKGTGAISYCSLIGRVFDVDRESLALTEADFRRTYPSLGDIPLVDGWSGPIDRTYDSLPVFGRLHENIHYGIGWSGNGVGPSRLGGRILASLALGRDDPWSRCPLVERRCRSFPPEPLRYLGGSLVRNAVLRKERAELAGTAPSATDRFLARFAPAGLEDKS

SEQ ID NO: 32007 - protein, 119 aa, Pseudomonas aeruginosa
GAHGMNPSLIRLDDESPFTSPTPVGQPLGEPVALTRTAAHRPLADGNGVTGIWECTPGRFRRQVEQAEYSYIVSGEGRFTPDEGQAVEFRAGDALYFAAATQGTWDIRQTVRKTYLIFD

SEQ ID NO: 32008 - protein, 354 aa, Pseudomonas aeruginosa
TAPAASSPGSCVTEACLRTRGNNQLSGLSRRYLGPLGGWLIFIAVAANRYGAMVAYMTDSGNIMVELFGQYGLTREVGSLILLVPSALVLYLGLKALGVGEKLISAGMVAIVCILIGATLMQDDARLAHLWQSQWQYVVPVFNLAVFVFGAQFLVPELVRGNLATPGRVPRLIVVGMLLTFLGGGGHSCPRSSPLVAPDDISEVATLSWGRSFGRWAYYVANTFAWLAMLTSYWGLGGCLFTNIFDHFRVGSETHGRKRLAVLAAVSVPPFLLAYAGLGGFVNALYFAGTFGGVLMGIIPILLLNAARRHGDQLPAFSCGWYAHPLIQGLIVLVFASSGVYAIASALGMLPASW

SEQ ID NO: 32009 - protein, 537 aa, Pseudomonas aeruginosa
QGALPAPGAITLKAHAWSFLDMPQSIRHLIALPELRSRLLSGAGGLDRPVRWAHVCELDDPTEWLGEGDLLMTTGLGIPSDAERQRRYVRKLAEAGLAGMMIGENMEAPSDLDALRETAEALGFPLILTHYGVPFAAVTRAIVDAGQKDEYERRNALARIYESARLSMQGLGLPALLQRLGKDVRSSLYLIVPDTLAAWQPGLPGLPAELADALRNRRREQAEPQPDGPSPSARGRRSAQHRHSFRPELPADSPGRAAAGLQSPAPPDGSARHRDRTAARRKRTPPAPGFGIAPRPAARTAIPGNQAEERLEELLPGLDLDDAVVSVASSEGLATDPIGLFRGHDSRLLVRAQGQEIILLHQAGLASTLQEALDSSLGVSAPLRRAERCAEALREARLALAHSHSRRPLCRYAELDDEAPWLPRSLAEAERAFRLVLGALHDYDAANGSALLHTLQVFLEENRSWLNAAQRLHIHKQSLVYRIRRIEEISGRSLDSTADVATLWFALQATRLSPEARGRTAKGSLLEQSAHHGGDMD

SEQ ID NO: 32010 - protein, 528 aa, Pseudomonas aeruginosa
DGSPSARRKGGLRCVTESTLYPPRYPPCSYLLWRSSPPPSSDFPHALGRPPPPSARRGRPAFPAAPGCRLAPPRPADVPTPTAMPSQALHPPRSARRARPHRDQPGRPRPAPSNLRGVHPMNGSRSTFLYLLAAAGLALTPAAQADRGNDVVARLNQLYNDTRQDCGGPSKPAFLCSGVLFRATWPSTDYMFYSISPKSQKSGGVSASYLRKDAKYRKLAYGLKSGFIFDTIFGNPKDHQDYAVLCSFPIDAATDDRAQQGCTDSRRTPNSVEKSCQDINVSTAEQWAANYRQNRGDHSRQCSFDVRDERNTAAGPAFYQSIRAMAQIADESFTTQNELRLAKWEENPPKSPSILAAFYTEDAGLEGARLNQIQWYQSVQAFLPIINMRLPQTRQQDAQFAYDGRKQAIYPTSEKNACERYVESATWVERDDPGFRKKIMTLEVVPTDCGRKIQDNQTNNFFNELVVDHYLDSEWKDNPDNRDSNIGSMRRQLVCHFNVARNKPEWNLEPSRPYTSNEDSIAKGCNNT

SEQ ID NO: 32011 - protein, 162 aa, Pseudomonas aeruginosa
WNERRGRRPDSLADPRRGRRVAGAPAGQRLHRRHAPGLRPVAAAQPAARPCLGARRAPAAMPRPTAAGAGPADPRPRARAGPAARDQAPRPGPRRRLAGARHLAGRTVARLAGRPAHRRRRTAPPDPARRQPADPEHRQRRGPGLRRQPAAGTPAARRDLRR

SEQ ID NO: 32012 - protein, 207 aa, Pseudomonas aeruginosa
PRRPASVPRRHRRSAAACRCRPLQRTPGDGRDPGRGTRRTGRTEPAPRTRALAGKRRVGAPGRRRRSAPAGLRRPAGRLDPRHADGRPDAAGRGARRTRPLPSRRTALRPATGQAGGVGRLSAAGPAAHAGHAAGHLSAEGARGDRLLDQPGAGVTARPPSPWQPPPRVHPGRPSAVAPEQALPSTYRAPQKNNRLDLRPFSFSAGK

SEQ ID NO: 32013 - protein, 107 aa, Pseudomonas aeruginosa
PSPSPERPPPCLPPRRPPPARRAAMTSPPARSVAPCRPSPATTGCPWRSTRRSPRVAAAPPCAAATRRSRRCTACCWAAAWSCSSAATAATPWCRQPPMARWNCNPR

SEQ ID NO: 32014 - protein, 193 aa, Pseudomonas aeruginosa
RRSPASAAARATTKPSPPTASSSATRAISSTAWHASAATAAPIPPRSACAATSTPARSATTGRSAPTACTNGWAWSMPSPGCSRATSTRPRRIRRCRTSPASTGAFRRPMKPTSAAWRWPTGCRSSMIACRSPWACAASRSSRATTTRPAARAPATTSGTCGRRWPACWSSRCRTCRCTPTTSRASARARRRR

SEQ ID NO: 32015 - protein, 391 aa, Pseudomonas aeruginosa
PETADDQPMTAKTLRTWYLVHKWTSLISTIFLLMLCLTGLPLIFHEEIEHYFEPHPQLEPLTAESPRIDYDDVIVRALAARPGEVVRFLVFEKDDPLGLVISAPSLVPPPENGHMQPFDARTGEFFDALPPPGGFMYLMLKLHTDLFLGLPGYLFLGLMGLLLVASLVSGVVVYTPFMRKLDFATVRAERSRRLKWLDLHNLLGIVTLSWVLVVGVTGVINTLALPILMLWQGGQLAEMTAPYKDAPPLQRLGSLDAALATARRAAPDMEVSFVGFPGTQFSSQHHYAVFMRGNTPLTERLLKPALIDAQSGELTDMREMPLYVKTLLLSQPLHFGDYGGMPLKIVWALLDLVSIVILASGLYLWLGRRKTPLEKRLAELPDGSLATEGKA

SEQ ID NO: 32016 - protein, 145 aa, Pseudomonas aeruginosa
SSAGPCYWPCSASSGCSRRCSATASTTCSPGSPWALRWCWSAGSGCACREPEGTPEMTTPPPSANTLDLRPLMLETFVCTLAVMSFVALVGPLARKLGLAPWQAGAAVTVGGIAWMLAARPWGIASDRHGRRRILLGGLAGFALS

SEQ ID NO: 32017 - protein, 313 aa, Pseudomonas aeruginosa
ASLCLFIVLALHWTLPTLLAFAGIVLLRGLAGGLYAAVPACTAALVADHVEAQRRAAALAGLGAASAIGMVIGPGLAGLLATHGLVLPLLVTGALPLVALLALWRWLPREERRQPNRGAALAIGDRRLRRPLAVGFVAMFSVTVAQITVGFFALDRLRLDSADAARVAGIALTAVGVALILAQLLVRRLDWPPPRLIRVGGLVAAIGFAAVCFADSPPLLWLAFFVAAAGMGWVFPAVSVLNANAVRAEEQGAAAGTLVAVHGFGLISGPLLGTLLHQFDSRAPYALVGLLLALAAFWPSQPTRPVETRSEAP

SEQ ID NO: 32018 - protein, 221 aa, Pseudomonas aeruginosa
PLSTCCWSRPCWRPCSPGGYPPCPAAVACWRSPRRWRSAPACTLYGTTAGKPASAPSPVSPCCSAPVCAGSPCAACRSGPVRCTACWCCWQSPRCTCSRSRRYRRRAAPMRSACAISNWTTPAGPACSAPRPGSRGACWYVPGTRRARSPAPHHATTSTRTRHAAPRGASVKYSAFRRCSPTSSTCAPIPIRTPRYATTPLACRWCSTATATAPSPAATGP

SEQ ID NO: 32019 - protein, 169 aa, Pseudomonas aeruginosa
WKNWPATATRSTPSSTAATRRRPACPTARCCPWTPGWSNTCVGPPTTACRRPCARAMSATISTSASTASCTPPSTCPPRPTAPSTSARRYGWPTACSSMTACRPARSRTGSPTWWPPATSSTPARWACPSAARPPARSAWSTDAARRPSTSTAATSTSRPSIAISRRRC

SEQ ID NO: 32020 - protein, 261 aa, Pseudomonas aeruginosa; identical to SEQ ID NO: 22611

SEQ ID NO: 32021 - protein, 158 aa, Pseudomonas aeruginosa
LDLARVCRDPEGGLMVDVRSPEQRRAIMQSVGTAHTGPEMTVRRILHGLGYRYRLHRKDLPGRPDVVFTKKRKVIFVHGCFWHGHGCSKGRLPKSRLDYWEPKIARNHQRDQDVENALRSLGWQVLTIWQCELKDLQGVEARLSAFLGPREKTDRHRR

SEQ ID NO: 32022 - protein, 78 aa, Pseudomonas aeruginosa
NRVNSPLVKGDDVLAVGGIQMTRPIGIDLFAGAGGMSLGFEQAGFDVVAAVRDRSNPCRCSLLQFSQLYGNPPVRIFG

SEQ ID NO: 32023 - protein, 79 aa, Pseudomonas aeruginosa
RMSGNKAVSPKATAAPKNLTLDAEAVTTMQALIVIENLFINLFANRGTSYAASYSAKQSTDKSASNTANGYPYWATDHA

SEQ ID NO: 32024 - protein, 320 aa, Pseudomonas aeruginosa
KWCRWRSCGGFSGQLAEHFFQLAVFGTHPGYPPAAAVDQAVERGKDLHAGAGQNGQGAGPVGASFDTGDAGEHGDGQRVYRCFDAEADGMVVAAAGPEFARGVVGQQAAAVDHQGAAAHERDFLEDVRGNHHDLAFREVLHQLPDLVLLIRVEAVGGLVEQEQLGIVEDRLGQRDAALEALGQGFDDAPALIPQLHAVHGAVDAPTFFPSAVVADGRDEGEKALDRHFSVAGSVLRQVADQLLCLARLVLHVEAEDAYAAGARREEAGKHLQGGRLARSVGAEETDDLSPVDAEAQVVYHRPAGKAFAQSVYVDHGFTGS

SEQ ID NO: 32025 - protein, 187 aa, Pseudomonas aeruginosa
TGSGIARPPGSSELRDQCKLEEDPTSASSGYSSPFSSGRRISKVVPWPTWLWQPILPPCRSITVLTMASPRPRPALPSAEAKRWYWLNRRGSSAAAIPLPWSTIRQLSQSPSRRMLRLTTVPAGLYLTAFSSRLNSARVSRPGSAQTIGSCSSSQSRRRSMSFCCARGQSWSAASIANMVNMHASKR

SEQ ID NO: 32026 - protein, 196 aa, Pseudomonas aeruginosa
TCWPASSSAGRTSSRARIAECGARRSWERKRRRVARWRSASRSALRSIRLTSQPMAVSLSTGSRRARSRRRSRSRWSRNSMASRVSSVGRAPPARLGWPSSARRWRSSAPRSSPPNRSRALRLASRICPCGSQIRVATGRHSRPSAMNRRLSRVRLTACSRAAMRFCNGSLPARGGLARSGSTLGSRSRRASSQPK

SEQ ID NO: 32027 - protein, 131 aa, Pseudomonas aeruginosa
PIPSSGTPAASTALPQPPNTSQKVPKNSAPYCFMMRSFSDPGWDADRGVRIAGGDDSNKEGEMTHPCVEASPGGIGLVAWGDRPLPTPDCGSSGLVPRPAGAGLHIPVSEQSICSLAYSAVGNLPSAICLL

SEQ ID NO: 32028 - protein, 191 aa, Pseudomonas aeruginosa
KSPAAAGLLFGEARLLLERGHGLGDLGAGGVGVAPAFDLDPLAFLEILVVLEEVLDLFQQQGRQVGVFLHVLVQDAQLVVRHGDQLGVAACLVGHVQDANRARADHRTGSDRIGGHHQHVQRVAVVGQSVRDEAVVGRVEHRGGHETVDEQAVGVLVDLVLDRRMVGRNLDSDVDVVRQVLAGRDLAVAHG

SEQ ID NO: 32029 - protein, 326 aa, Pseudomonas aeruginosa
RNHRDTAPARGSPGTSSAPAGATAAVAPAPPAAGGRSRRDRRRRVRSGACRRETARPARAGGGPRRRPGRRGSAGAGVPAARALRPPGGVPAGAGAARRGTTTCSVALGLGLFGGARLQAMANEAEDHRQQRQQDDADHQQRQVLLDERHVAEEVAQGHQAADPGHGAHHAEHDEARVVHLRHAGDEGREGPHDGQEARQGHGLAAVAFVELMGAVEVVAAEYLRVGVAEQPLAEGPADHVVGAVAGDRRDHQQPAEQPWVHAAGGADGAGDEQQRVAGEERSHHQAGFTEDHQEQDGVDPDAIVADQHGQVGIQVENQIDWVEVH

SEQ ID NO: 32030 - protein, 155 aa, Pseudomonas aeruginosa
QGRACDDTPAFCPATAQSRPGRRARPPGAGRAGSRRMARASPRTGSGVSPGAALGTRLRQRGAGHRRPSRRPVRRLRLYPRGLAGSAGGAAGPGFAEHAALSPAPRRRAGRARAGGGVAAGPCRRRALSPVRRRRPAALSPGQPAAPGRERPAAG

SEQ ID NO: 32031 - protein, 342 aa, Pseudomonas aeruginosa
QRGAGAGPAQPDPGGRRALVAGAPAAARSGRPARPRRALCGAGHGAPGGRAAAVAACAGGGGAGLAGGARARPGGATAYRLASAGRGVPRRLRGWLDLAGSLRVRPARAAIPRLRRARTRGVAAARGGRCRRSVLAARMGIAALPCGEPAASIVVAPVASSCLPVVRSAALADAQPAGLGASAPAAGTAMRAGPPGATYGCGSRLAAARRTGLVAGRRGRSCWTRAGACCSSPRRRRSCRGWRARRCLRTACRWRRSCVAARRSMAGPTSSPWRRCSIGCSVVAGRRSPARRATADAATSPWASVRRTCRSAGMGYWRGPWRRVRRRASKRCRNSGWPCRSR

SEQ ID NO: 32032 - protein, 320 aa, Pseudomonas aeruginosa
IGRRRGDARRPILRPGGSVPRQEEVAGARSLAVQRLDLRLVLQVDPGKLPPAGLAHQVEQAVRGHAVAEAFQADVGDAVAIGVGEADPRGPGEVQAEAVRRAEAGTLADQDHAHLRPQQFTDLVGHRHPSLFHQDHRRQRPAFGQRLFLQAFEEGQGVTLHGQRGEAVGDHDGQVDLPVVAGGVFAQALHRGLVEAPAEVRALQVDVAVGGGAVQQQAVAAALAQAVADGRMVEGQVHGVARLGVGVLEVQLRAGRQAGAGAAQGDPRGGQLAQRQPGVLGAGVGQVLVVHRHLLRPVAPGPGGTPAVTRHRSGCARRPG

SEQ ID NO: 32033 - protein, 685 aa, Pseudomonas aeruginosa
SLGRPYAGLWQQVQVMPRPGSLPGRIGRSSVPVGAPRFHHEAAAARAAACRFSTLTPNGNPIMTTRTSPAPAGLLRPSLHCLAFAVALGSAGAALAKDVTWEDIANDDKTTGDVLQYGMGTHAQRWSPLKQVNADNVFKLTPAWSYSFGDEKQRGQESQAIVSDGVIYVTASYSRLFALDAKTGKRLWTYNHRLPDDIRPCCDVVNRGAAIYGDKVFFGTLDASVVALNKNTGKVVWKKKFADHGAGYTMTGAPTIVKDGKTGKVLLIHGSSGDEFGVVGRLFARDPDTGEEIWMRPFVEGHMGRLNGKDSTVTGDVKAPSWPDDRNSPTGKVESWSHGGGAPWQSASFDAETNTIIVGAGNPGPWNTWARTAKGGNPHDYDSLYTSGQVGVDPSSGEVKWFYQHTPNDAWDFSGNNELVLFDYKAKDGKIVKATAHADRNGFFYVVDRSNGKLQNAFPFVDNITWASHIDLKTGRPVEREGQRPPLPEPGQKHGKAVEVSPPFLGGKNWNPMAYSQDTGLFYVPANHWKEDYWTEEVSYTKGSAYLGMGFRIKRMYDDHVGSLRAMDPVSGKVVWEHKEHLPLWAGVLATAGNLVFTGTGDGYFKAFDAKSGKELWKFQTGSGIVSPPITWEQDGEQYLGVTVGYGGAVPLWGGDMADLTRPVAQGGSFWVFKLPSWDNRTASR

SEQ ID NO: 32034 - protein, 154 aa, Pseudomonas aeruginosa
RPSSSAPPCSAPAWPRPPTTSTTSASSPAAAWSPARAAPRPTCAAPTCATSTSAASTWPAPISPAPTCVTPGSTWPTWKKPTCVVPTSPVPACSKPTCAGPTSPAPGRWRSRPGACSPRAPSGKAPTSPPPTWSSPVSAAAACTRPRCAPPTWR

SEQ ID NO: 32035 - protein, 418 aa, Pseudomonas aeruginosa
PAKEFPAAPPARLLRRRRPRSPPRRGAARATARPALRGPRNDRPPAGSSSSSPLSRRVPAASAGATPGPVRDGCAGSVQRPGSARAGASSPGRSRVPGPPRSRDRRRVRSGRESRHGIAGGSARGWRRHAGRRCSAPPATGGRDGSRPPHPGAAADRPGAARRRCPGLPASPPRRRAAPRPATGVAGPAAVDRAAARGSCRPAPGSSAPGVPAPAARRLPCSAATTVGCGCPSGTGRYRHAPPGPASAARAPARRAASGTPPGRRVAGHPWRGSGGDPTGLSDGAGGRSFLAEVAGIEEIEPEQAEDQQDGQHQGDGDAHGGDSCPLSLSRHARTRGATACYYLGTAGPLLLRGHPPPAALAGAADAAGALRKRLVLLLWYWFTPPDVEFPKQRACPVMTHTRRNDEKPPCPALPCPA

SEQ ID NO: 32036 - protein, 77 aa, Pseudomonas aeruginosa
RPTTLRRSRRSTEFAFSAYPAADAPRRVPGSARRNAHPLGYRAHDCYRERIRIRPRAPSRHQPPITTITRCRPCTRS

SEQ ID NO: 32037 - protein, 600 aa, Pseudomonas aeruginosa
PFAGGYLAVLRGQVAEQFAKLERGDVRGDHAGVQLGNVHQGAEQVLHVLQRMADVVHQRLVVPRRAAALLQGAGEQPRGVQRLQQVVADRREELGLRQVGLFRLALGLAQARLDLAALVDLALELVVEGGQLGGPLAHPLFEVLVGLVQRLGGPPALGDIPNQHEQPGDPAVGLAVRHVGALHVALLAGQRGLGDLEGHAFAGQGPLEVRLQAPAVLGAMHVAQAAAEHRAAGPAVPLLVDLVGEFVDQFVAEIGDQRRHLVGDQADPALAGAQRLGVAIAFGDVGEGVDEAAGGQRMGTDLQHPAIEQALLAGAQRTPLGVLAARREQRQFALRHHFGEGPVPGDRGQPAELQEAPVPQLQHAVGTDHRHALGEIVHRPLQQVRLLRQRLLAARGLAELDLGDVAVEHRQPAVAGRSLAHPQPALVAQAVQGLLVAAALLLDDQPAATRQSVQFGATHARTDPRPAVDPQRAEALVEQHDALLRIEQDEGVGDAFDSVEQMLVGGLGTQASVAEQLVAGLQFEHRLAQRVGALADLLGQHHGILEGAVGLVALRGARLDASDQRLVDPLQLVPLFFEGDDPRLQLSDGHLRGVGQWRPR

SEQ ID NO: 32038 - protein, 151 aa, Pseudomonas aeruginosa
PGRRAPATTASGARRRETPRRRETTGARGSGPGRDARSARRGCPPPPAARQRRAMPPDHAPGAGAGRWAARRRGSWGGVGRGDPWASSRVPRLNLTLPRGEGNSPFAGSYQEAGGSWPDASSEYSARPPSALSACRTSGARHGANRSRPGS

SEQ ID NO: 32039 - protein, 91 aa, Pseudomonas aeruginosa
  UNSURE (91): Identity of amino acid at the above locations are unknown.
AGPWLPIWCRTSTVSCCSPSMKACKSRRRISSWHSPPAHRAGSLLSLRSWKATRSQVPLQPDWLSRHRTRRPARCNTSRRPSWVRARASLX

SEQ ID NO: 32040 - protein, 460 aa, Pseudomonas aeruginosa
VPFPLPPGKPFCEFPRAARYLSSMNALKGRDILALGFMTFALFVGAGNIIFPPIVGLQSGPHVWLAALGFLITAVGLPVITVIALAKVGGSVDALSHPIGRYAGGLLAAVCYLAVGPLFAIPRTATVSFEVGVVPLLGESGTALFVYSLAYFLLALAISLYPGRLLDTVGRFLAPLKILALAILGVAAFLWPAGPIGTAQPEYTQAAFSQGFVNGYLTMDTLAALVFGIVIVNAIRSRGVQSPRLITRYAIVAGLIAGVGLVLVYVSLFRLGAGSHAIAADASNGAAVLHAYVQHTFGSLGSSFLAGLIALACLVTAVGLTCACAEYFCQRLPLSYRSLVIILAGFSFIVSNLGLTKLIQVSIPVLTAIYPPCIVLVALSFCIGLWHSATRILAPVMLVSLAFGVLDALKAAGLGQDFPQWLLHLPLAEQGLAWLIPSVATLAACSLVDRLLGKPAQVAA

SEQ ID NO: 32041 - protein, 100 aa, Pseudomonas aeruginosa
RSGAVVSLSTIPPGKRIQEPVMAKALISVLLFSLALAGCASDYNPSRPYSSDEVRQLALEDLARRSLSFEEYQAKRQAILEEKPQTAVSQSNAALRSTAI

SEQ ID NO: 32042 - protein, 394 aa, Pseudomonas aeruginosa
DNSPNARHHTPPSSRYSHVMTLAAALHECPQDRPMLQMERSGKPRPVADRYRHGPGVRKSSIGKEVDLHREYHHAVRRQAAVRERFRQVRQRQPLRPDRRQRLRQVDLHEDPRQRPGAERRPGHAGTQRAPGQAAPGPVRLRGLQRHRYGDHGPRGTLGGEGRTRPHLLPAGNERGRWHGGGRAGSPVRRVRRLHRRVPRRRAAARPGHPAGAALRPDERRRSRLEAARTAGPGAVLGPGRAAARRTDQPPGHQHHPLAGRRAHRAQQHHDHHFPRSPLPEQRLHPHGRPGLRRAAPVPGQLRRVHDRRRTGPRAPAVGQRQEEGADRRAAILRQPLLGQRLQGQAGHQPRPADRQDPVGRGQAVQPGQPVHPLRAIQEAAPPGGDRGKHQQGL

SEQ ID NO: 32043 - protein, 207 aa, Pseudomonas aeruginosa
DNLFFPPAERLHAPRPQRPLLLRQGGGMRRLRRGRTRDGDSQVAPVAAHRRAGGAPSGAPAAPHDTQAGAHGGRRTLPAALPQPAAGSGDGRTGDRRAERRAAWPAAPFRTGGHGFEQPGRPVAAVSRTTPAGPAGNPPDQPPGRPAQRGGGRGTARARTRRRGPCAGLPAPGSGDHADPRRPVADRRASPGTSGRPRRPALPRRYS

SEQ ID NO: 32044 - protein, 547 aa, Pseudomonas aeruginosa
ASSGQRACPSRYIRQAPAAGSTQRISRTSSFANGRCNALGGVGAGRAWARVTGAWAPRRTVGGSMVSASSRALSARRRPWASWLARNHTWSPWRGRRSPRNAEICRKTSSPPVFGRMKPKPLSSYQRLIMPGFSISTSTRSLPVSRCILATRGGQTKKGAARAAPLACSRASHLAGGAPVDQVELPGRQDQQAEGDPIPGESRVAVVADELQQGTHRQHGEDERGDEADGEHRQVLGAEQVAVHVSGIDRRADHGRHRQEERELGGRLARKAEQQAADDGRAGPRGAGDHRQALGTADLQGVLPVHVVDVFGADHMLPALGPEHDHPAHHQRQGDGDRIEQPLVDQVGEQDAEDYRREERDQQVGGETLGLALARQVTDDLKDLSPKFPDDSEDRRQLDDDVERLGAFAAEADEVGDDDLVPGAGNRQELGQPLHDAQDERLESSPPLHVSPPSTTVPNELSLFSAIHSPSFMKALRLRRTRPVPPLPKSKPAGMLPERPARNLGILASRRLNKSVRARPLRPGLREAPDTFATMRPRRMRAFRVTP

SEQ ID NO: 32045 - protein, 361 aa, Pseudomonas aeruginosa
TLRRFARRHRRLPDRPPESLVLAYRPGDGGALRLDILRGEALFGHAPANGLRGATALWLVAVDPRRAGPRRPLGEPPERRAAPLRARCGPGRQRRARLPDGQPHRCRQSLVGRRIDRLQPGGAMLDGAEAPGMLGPVDRRRRAVRGALRQQGAVPDRRPLRPLHPAGDPRLADLAPRPGIARGRRRMKVLVLTGPESSGKSWLAEQLQARFGGRVVGEYVRHFIDEQRRDTCYADIPAIARGQLAWEDAARAERPALLILDTHLLSNILWSRILFGACPDWLEPALLRRRYDLHLLLSPEGVAWSADGQRCQPELAQRQAFHRECHAWLERHRQPYRAIAGDWAERRRQAFAAVQGLLRDG

SEQ ID NO: 32046 - protein, 259 aa, Pseudomonas aeruginosa
QRSRAKRGADQSLRFGHSGPGGTQRLDGRSRLRREQRRGAGEPERWGGQSVDEHPQRQGHGMSLPSQHKPNTKHRNARRNAMKATMVPTPLALAMAAVLSVSAYARKRRWLAPAETQPAVEQQGRSHGPGGGYAAELQQQGQQLRHAEQCLGERLDQGCLGQRRGQRRRRRQQPAGQRRRAGQRRRQLRVRHRDRQHQRAAERLRQYAEQLLQPQHRIAEQLGQQRLGQPGRERRRRQLQPAEERPGRRRLQRPVQHCR

SEQ ID NO: 32047 - protein, 266 aa, Pseudomonas aeruginosa
  UNSURE (114),(115): Identity of amino acid at the above locations are unknown.
WNSASSRAISSDRRSRMLREHAMYTHHCFVLACCLGAALPAPASDLFAPAELSDQELSQLRGRYVLPGRIVSFGVTMSSTWQNASGQVLGARVDLQVRQNLARPVLNVTLVDRXXDAPPPAAGNGQVLGGAGLAQTQGVSQSIRTAGDHNSASNGVSIEVRHGDAPPPLPGGTPLEGALALSGEAGTVKVTPNGGALQLAIQASGQGASLQSLGAGGLVQSVALSGNRNLVQNLAALEVMLKDRPGADPALNCAWEQLRALRPSGY

SEQ ID NO: 32048 - protein, 437 aa, Pseudomonas aeruginosa
SEITVLSEGHKNGTANMTQTLSLRAVLCATTLVSPFLAQAATESEVEALKKELLELRQRYEAQQNALMVLEQRVRQVEAQPQAPQPQRLVKSIQPPAQARNDANAVAGTYGASLKDDGAPAPSVENIYQDASGFFGGGTFSLETGLTYSHYDTRQLFLNGFLALDSIFLGNIGVDQIDADIWTLDLTGRYNWNQRWQVDINAPVVYRESTYQSAGAGGSTSQITEKSVTGDPRLGDVSFGVAYKFLDESESTPDAVVSLRVKAPTGKDPYGIKLKQVPGNNNLNVPDDLPTGNGVWSITPGISLVKTVDPAVLFGSLSYTYNFEESFDDINPQQGVKTGGKVKLGNWFQLGVGVAFALNEKMSMSFSFSELISQKSKVKQDGQSWQTVSGSDANAGYFGLGMTYAVSNRFSIVPSLSIGITPDAPDFTFGVKFPYYF

SEQ ID NO: 32049 - protein, 742 aa, Pseudomonas aeruginosa
RTARRGSRRPVAGAARAPPGPCSGCPPPVLSLASLRPCSSLSLARAPPAPGSDPHQRRRGGFAQDQRRRHHPPLHRLLALGDALQQQLRGDLAEQADRLAHGGQGGKHEAAQLDIVEADHRQFVRHPDIQLGRGAQHADADHVVAGDDRRRSLALAAQQAERRVVAAGAAELAFQQPLRAHLQAGLGHRPPVALDPQRRNLGRQRPADAGDVAMAQLEQVAGRQVGAHLMVDLHPVGFHAFHLAVDDHGRRAHVRQPLGQRAVAAGGRQDQAVDAFLLEHAQVVGLLLRVVVGVAEDHAVAVALAAILDAPRQLGEIRVGAVRHQQADDRGGAHLQRARHRAGHVVQLRDGVLDLLAHRVADRPRPVHHMRYGGEGNPRHRRHVLHCRHRSALSAGAMAAVGIQHHRYHDHRPGNDSFGRLRRTDLRQPRRQYGNDQHAEEGADHRTSPAHQAGAADHHRGDDLEFQADPGVGVGRFQTRDLEQRGQPGEQPHQGEYCNLIGFRVHTGQSHRFFVGADADQVAAKHRAGEHRLGGEHHQQGDHEGRRDAERQRIGQPGIGVADIGRARVGHLVGQPTGHLQHPEGHDERGNPPGHRDRTGDAAGQGRAGHPEHRRRQHAPAPAERRQAYRRGRQGQHRTYREIDAADDQDEGHAHRQHHQVGDLVGDGEEGAIAEEVAAQRREQRDHRQQRAGQAEVGAQAEIVAASQGWRCGGGSGRRRVAHFWFLALRVHDVASSASRFL

SEQ ID NO: 32050 - protein, 136 aa, Pseudomonas aeruginosa
MSNLAPTSMPRVGSSNSSTWQSRSSQRPITTFCWLPPDSSPTACAVSAQRTRSASTWRRARASSRRRSITPWRASAGRLPRARLALIDWSSSRPSPLRSSVISATPWRTESAGERRLRRCGGSPSRTCPPSARSAP

SEQ ID NO: 32051 - protein, 198 aa, Pseudomonas aeruginosa
PTTFTCPARPAARTADTAPRAMLSLPASSALRSGCSLSIAEATALPFSISQLPDCKETIFIPAASIASLKPAVRCWALVVVETPSMMPTSSPAFSRFARYSPTSRAPLRLSGPTKGTPIFFACSTCGSKRLSMLTTTMPASSAFFTTGTSALESAGAITSASTPETIICSTMRIWLEVSVSSLMPLETSSNRSACSFW

SEQ ID NO: 32052 - protein, 90 aa, Pseudomonas aeruginosa
SPRARSCRRESSAPAGSPGARRPSPVPAGSPCRESPWPACPACGCAAGRPGTPCWCSAGSTPGRPSPPTLRSRPSWRNGRCGRRHWWSRG

SEQ ID NO: 32053 - protein, 103 aa, Pseudomonas aeruginosa
SCSTRNDPHRPALRRGDVLTYQSIPSIVASETIHFSFANADVYIVARSPNNQNGTGDDTMSYSAKSFSALINAMRADGITRLEQLARQPFRNAQGFWSAEAKK

SEQ ID NO: 32054 - protein, 202 aa, Pseudomonas aeruginosa
RACTTTGSPPSNCPSPKNPSPPPNTSPASASSSIRSRRPATSTPATCRWASASTATRRPAPATWTSPAPPATPANCATRASRCASTAAPPCTPSPPPCRPCAAAPSARRSARAWPPPTTTRSSSTASPGKSSANATNRTSRNCAPTSRPYSTPSCAPPGTTPAATSTPPRKAPAAPTPSGASPTASSAMPSTRATTASPTPR

SEQ ID NO: 32055 - protein, 393 aa, Pseudomonas aeruginosa
AIRRSGTSGNSTGCNGTARPCSRWRAISARPSASARACRSSTSTASRCRASSATPPAYACTTCTPWKKPATTETTDLAGRPLRPHRPATRLPGPRPIRSQLRLLPCAQGATGGIRRPRTQSRVAHAHGADRGDRHRPDHRRQHRRPPLRPAQARLERRRTGADERPADRRRSAATRPLATVLGQGPGLHHRPRRAARLPGRRHPAGTAEDHERLRPADRRTGTARLQGPPAGRRLGDPAVPAQRLGAQPVPTALPGRRTLAAVLRRHLRIRSEIRWIPHREIPRRLPPRHPSHRQPQQRPRIPRRLPAERRDRPRPQPGRTLGAGGIPEGARQPRIRAPPGPGPDPTLDARPEMPGAGATDRATLNLGNGEARGMAPPPLSTPSSPSPFRGDA

SEQ ID NO: 32056 - protein, 122 aa, Pseudomonas aeruginosa
PEDGEKQSWRTPRPRRIKAHSQRTPPRTPTPCAHSSPTPGCSSANGSAACSSCCWPSASAAGPSAASTTPGNSPARCPRKSRSPRTKPASPRRSSRTPSAWSNSTATTPASCAMPTPRPTAA

SEQ ID NO: 32057 - protein, 120 aa, Pseudomonas aeruginosa
RPNSRYAPTSTRPCVAACSPKRAKAGTPGCASPTATPTRSSTARTTRAAWPSSCSTCPAKNSCPAAAMTASRTSSCSTSRCSSSATSPNTGRTSPPRPTARKPWPSSPTGTPPAGNCATC

SEQ ID NO: 32058 - protein, 459 aa, Pseudomonas aeruginosa
ARQNGFLQVVELFDDAGRYMAVRLEFETTDSQEIELAKRYWAMDEEGAYLERVADLLPFREITQASMVAKFVRQICTAYDENQTCPKCDGQIQIGGRTEAKKVIQRSNQPCEECQKIQDEERQKEEAQQRAELDAKLAPYISRAREATISYSALPDDTVLILQAIHALVGPLLTQGTFSLDDCEAMTPQGTGGLIDRLYKQNILQDDPAAAKPGTYWIQDEKLWFSKASARYFLPPDADLGGSQAALNMLFEREFSDSVALTELWLDHAVTDVMCYFEYQCDVHNHILCAADVDKIKATVRHGMRKYSVAQMWFIMWKVTRDAAALASRSYYNRETAAATIPNKIRKQLENADQGTELRNEWTRPEPHITGSLGMMFYSLFGLDEYTKGTDAQALFDRLGEKSGGEINLHALAAAFMKTALENESALFALEDFAEMVRVGLTTEDALKETIDRNPGLFQ

SEQ ID NO: 32059 - protein, 151 aa, Pseudomonas aeruginosa
GRHWYAQTIAPRPRISQAASHASAGPRYDRCARTDRAPTSRRRIPKPTSRRKHMAIDLYALAEQVEDEAGFLHFLAALAADWEEDRRLAAANPPKPFGPSPLGWENGSIGGFLDAAATWGEDSHDGLPGYSRPENAWRRAAQLMLAGKFYE

SEQ ID NO: 32060 - protein, 293 aa, Pseudomonas aeruginosa
LQICPGALPARLPEGLAGQPAAGADTASRRGLPPARAATRRFRPDQPLRERQPRAPGAMGAAARPGVFFRGQRPRPHPATGGEHGRRRGASPAVARSRRRRGAGALQLHQYRPRGIPGLPPGLFPGRCGAGPRPDGTSPAGSQPVLLRAARPAPDHGQPPAAQRTQRAPAGKPRLREGRLRPRLPEDRRGLGRPCATGAGGRSALNRRANAERDARRPVPLTRPAGQPRARSPRSSRAAATMFTSAASVSGQARVFRPQSGLTQSRSAGIRRAALRSSATISSRLGTRGEWMS

SEQ ID NO: 32061 - protein, 223 aa, Pseudomonas aeruginosa
PSSCSAKYSTMSLRSASPCTSTSSPSCSWICTAWRISLCIASMYSASLSLPCLNDWRARRIDEVCGKEPMVVVGNAGRSSPARCLAMRSANGERRWASLALIAARRACTAGLWIRGEEARLAWTARLSSRAASTSAASGSVAARASTATSRHFCTAKASQLFSSASSPSSRSRSTGLCSSEQDGATHSRSPRRSRAWRTTSRAFSRSQRQTLRPLTRPSETTL

SEQ ID NO: 32062 - protein, 286 aa, Pseudomonas aeruginosa
PSRGSGRPPRRVRGSASAGLPRAFDGAQFLEQPAATHGKDEEGDAGGDQGQDHRGKRHHQVLADPLGVVAGQRQQCRSHGDHGRHQAEHRRAARGDPQPFQALHDPQFEVVAVAAMQRLPGRQARAVAPATALPGFHGEAAEGDEGVGQRGEDQQQHRQQEQAGEFVEAGFQTIHERFSIGRRLTTDCRTAPAANSASSTAAASRSHGCGSPDGGGATSSRTRPLTVSPAPDAAAPSACAAASPKPPAIRSMNSRVVAAPTSPAPAAASCRQRSASSRRVCSLASQ

SEQ ID NO: 32063 - protein, 305 aa, Pseudomonas aeruginosa
RMPAVSSSSRRGNVSLAVSLEAQDPTLNRACPPGGKMTATEQIMALLERWDRQQEGYIRQREERYEAMFQLLEDLFGRDGRFTAIDAACGPGSLGRRLLERFPAARVVALDADVMLLEIARTALAGFAERVRVVECDLTDPGWTERVAEARESLAGERPAALLSSTALHWLSPAELAGFYAQAGELLAPGGVLLNADHMRYDRRWPGLAELSRKHRERVLQASVASGADSWEDWWQRAAQIPRLAPLKAQRDAHFARRPLRRASEDEDCSLDFHLAALRQAGFAEAATVWQQLDNYVVFARLAQA

SEQ ID NO: 32064 - protein, 538 aa, Pseudomonas aeruginosa
GLRCRHRRRPPRRRPAYPRPRHARRLLRRLVAAHLAERRPERRAGAGRGRSAEAPGQRPGADGQLPRHPAERMGRGPGLQLLRYLPGALRAQGPPRLRQRAPGPPGVHLQPQRAVALGHPDALHQPDLRLGLPGRPARPGAAHRRRGDALRLRRAAGRDGPDQPRLHRGDAGRRRPWPGVHLPDPDLQHHPRLPLGQRQRHAPVRDDRALRPALLPELPQLGHAAQPGALDVLPPATGRARTAQAWQRPVRLGGADRLAGRGDDQLRAPGLSPPWRRRRPLPPARPPARTRLRQPGAEAQGDPAAHGCRPLSLHPTLPGYPAQPFLHHRRERPARDGAQLQRRPRGTAQRSRARDGPGPARSRARAAGGFPGGQRAPLQPGSHARRGHHLSLRPRGPQALSAHPPGRHAGGTLLHQLLATAGGLHRRPVRGAGAAGRPAMQVHRRHRAASLHGRADFLRRSLQDPGAHRPRSLPPAVPDRHPHLLDLPAARLPGRRARVLPEVRRGAAATLHAQELLRRLRRLSRLSFLSSTSKEYHR

SEQ ID NO: 32065 - protein, 216 aa, Pseudomonas aeruginosa
RVASSSTPSSVIRRTTRTMRCSVPSPSTPPPTTAPSRVAPIRGARRTASRSPARTSTSAPPSSGRRTTGRTAATIRGSAPSTSATSAIPPPARPSTRASGRWRRSPTNPSPPRTNCAWPSGRKTRRSRRRSSPRSTPRTPAWRALGSTRSSGISRSRHSSRSSTCDCRRPASRTRSSPTTGVSRRSTRPARRMPASAMWKAPPGWSATIRASGRRS

SEQ ID NO: 32066 - protein, 254 aa, Pseudomonas aeruginosa
GVPCEQRYGLLISHVLPCRLSKPPGNERMAFDAARYVHRYYASLAPAPGNEYPRLRAWEYLWEYVWDPSRSWDDLTAPEQLDTTALHLGFYLANWGMFRGSSGLLQNSNLDLMKALARQLFSGAGPELFELSLVDFAGNGARLAHNRKLLETVLGSMDALSSRVSWTDTLKSKILLGVWGEFPALDRHYVAACRALYPRRGLTSVNGGTLTALHRLIGEERLSFPRLETARKGLLYPTGRLADMAFFQYGLENA

SEQ ID NO: 32067 - protein, 372 aa, Pseudomonas aeruginosa
SRRPARQPAGQGPPGVSPGADRRPEVRSHRRAPGRVPGFGQALHAAGLPPVPGADGMNAAGEGRIPSPILDEAAEWLVRLQDSGCTDDTRQACAQWRQRSPQHAHAWERAERLLQCLGRLPPALALPTLGREHGLDRRRAIKHLALVLGGASLGLATWQAEPLRDWLADQRTGVGEQRRLTLPDGSLLTLNTDSAVDLAFDASQRLVRLLRGEIFVDSRADPRPFRVATAEARLHAGAARFNVRQEMAATRVAVLAGRVELSPLHGRGRWLESGESVRLGADGEARRLVFDGLPDAWTRGMLMADRMPLAEVLAELARYRRGVLRCDPQLARLAVSGAYPLLDLRRTLGMLQATYPLKVRGVTDYWISLVPA

SEQ ID NO: 32068 - protein, 472 aa, Pseudomonas aeruginosa
HRPRPARSHPVGLRQRQRGVPGVRPGAHRGSPQRRPARPLRAGRGAAPPAAGQRPGVAAAQRRQLHPGAGNHRWRAGTAILADHRPGRRCRDPARRVRRRPGSPWRAPGHAGQRRRDGRAIQHHQLHRQDHRAAAGAQRRRPATGQRSVGAGGRRARRPGGQLHDSRLQRAERRRRLQRSLWPAAVLAGTDRIRRARGSAQGTKRPARRDFPRRQRRRHHQPGAQARRRPAADPRQRRLDPAQPARHSPRHRPALRREQRLRRALQRRLPQRRYRRRPSEPRVSHALPGPGLPWRAPAPVQRPAVPEGKPGRRGAPAADRPGNHPHPPCPGLEDTLRPARFLPGPGGLLHGQPRRVRPRRQPDGVRQHRRPPEQLRNHRRQQHPRRQPGRYRQQPGTPARRPPHLFRRGRPARQLRHRPAPPRLDAQRQPPARTAGHGLCLHRDAAGQPLPDLAAYAAAGLLQPRREHSEDQ

SEQ ID NO: 32069 - protein, 283 aa, Pseudomonas aeruginosa
SRAGHPGRAPPADRVAQLRPDQRRAHQPRQAARVDADGQRAGQAAAGPVAVRQLHPGPQPGRGGADDRGQRRPGAGAIQGRAVRDRRQVRPGRLHHHPGAVRDQETERLYRRQQRLPRRRRATQPRRGAEPLWRTAGRRAGDGRRHLHQARAEQDRRPCQRRQGRARRGPPPGQPGGQLGHPVRRRTDPRQPLDLHRLGLCGQRQRPRRAALEPRRPRRRLRLPGRRQAAGGARQPGERTGQGLLDRSQRLPVDQLAAHPFPFPHGGLLSPPHHNQKPPMTSQ

SEQ ID NO: 32070 - protein, 149 aa, Pseudomonas aeruginosa
NTRLSAVARLPQAPAHQFLSGRPATRRLRSPAGGVLQPRLQRLRRRQLDPDGRTGQPRLRGLRHPAQRRRVADPPAQRHAAAHGPRAGRTPASGRPRRLAAGHAPGLCQRRSRPAPRRPVAHRPRPARPGQPRRQPQRAGMAGRPPVRP

SEQ ID NO: 32071 - protein, 353 aa, Pseudomonas aeruginosa
RFPGAAADAARRPWQLLPAVRHRTAGPPEKLQRLFLRTLRARRPAPGHSSPDTARFGPCRAYRQSAVHPPAAARRAARLGTDGSPHPGSQRPGAGFLRSLPARPRQRLSASADGALPRLADALRQLGGARLVAGQAGSPAPGAATTHRRNETAQDRAGSSLTTGYSGRPICGAPSMHIPPELIIHQTRHWTLNQRIDSALPGYCMLGSRQPATAFHQLPEQALAEFGPLLARVEREMDALLRPRRIYVGRYGHMPGLPVHFHLIPLYDWVEELFWEDTRYRTLQQFGVPTAEPLTDGAELTLFVWREFCERADPPAVRGMDRQQAIAGLRRAFGYGVQPRTSSGPDSESAQDA

SEQ ID NO: 32072 - protein, 199 aa, Pseudomonas aeruginosa
PRAVGWASRPRRAMKWTPPSYGVKRQTNGAATSPGGGVSMNLSRIGLDLAKQVFQVHGVDRHEHVVCRRQLKRAQVRDFFRQLPPCLVAMEACGSAHYWARELRELGHTVRLIAPQFVKPYVKGDKHDAHDAEAICEAASRPSMRYVPVKSAEQQAVQSVHRVAQSLVRARTGLCNEVRGLLGHSGLIATRPGRTATNG

SEQ ID NO: 32073 - protein, 597 aa, Pseudomonas aeruginosa
MRLHRLCISGFKRLHDVQVEFGNATFLIGANNAGKSSVLKAIEWLLSNNKRMEPGYYCSEVDEDTGENKIVCKTIVLEAEFRNVPEKASEWRGFKGRIFSYDAGDSGESGKSIFYRKTYPLGEDVKIELKSLTRSMKAEFVGLQKPEEFIAAGAESAVIEEIFSVLDKKISAGEKEKLELVDDIWELSDEQQWITNPGGIGTVVLSKLPSVLIIPAEAAAHEIDQKNGVLHKILNELFKEVRESSKNYKDAQVCLDLLAKELDPGDAGSEFGKMMSELNTVLGGVFPESRIYASADLSSPESLTPTFAIEMSSNVRTSIAHQGTGMVRAAVFGLLRFRQQWLKKRAGNDDRGLIIGFEEPEIYLHPSAANQMRDLIYELSDSASQIVATTHSPYLIDLSRKPRQVLNRFHYGNNHTTILPFSVSEEFKKLQGDDKDQVKMLIKLDDHVSRIFFTKKVLVVEGDTEEILIKEAIRRMPSDMRVRVLSNTELVKARGKASIIGLVKYLSALKVNFFVVHDRDKGVAGAEKFNDPILKVVGDKEKVIMLEECVEDFLGYPPPTSEKPFNAYKHSIGWGEDWGGVPDKLKELLKKAYHPLM

SEQ ID NO: 32074 - protein, 90 aa, Pseudomonas aeruginosa
THHSVTIPCMGRVSVSHDKNRDLVRLGAVVRAHRVALGLSQEALADAAEIDRSHMGKIERGERNVTFLNILRIANALDRKPSVLLAEAGL

SEQ ID NO: 32075 - protein, 368 aa, Pseudomonas aeruginosa
NMKKKEFLSVEAALLESTITYFDTYNANVMAVGGERNAVLKIKDIEMLVKEISASDEVHFYEKISHGVARADLTKTGKRLLMNVWAWEEIERYYPIHDFTPGVKVFFECTKEYARAFYYRRNLRLFDGSPSAVIESLNNVVERIRSIVRGCAFKSEQNAHRRLSNKNYKSLLGYIDAIFERRSRVLVLRVDLGYSKLLAQRSFRESLNFDEVKRHREKLLRLLRRKLPAKTFLGHAWKLEFGLSKSYHYHCVFFLDGSRLREDVAWARTIGELWVGRATEGRGVYYNCNRAKGNYRACGIGMVEHSDRSMRKNLQKAAVYLTKVEYYIRIATEGRARTFGRGEMPKRNIKKMGRPRQSPELEDGKPTA

SEQ ID NO: 32076 - protein, 256 aa, Pseudomonas aeruginosa
QADENGQGKGDDLVLRQRRHAGSDGQVAAGQQPAGQVAGDDRAVVGRAEVVHRQRHREGQQQRQPGAEPGREELAGDQGGAGDGQGHQHLDGAGLALLGPQAHGQRGDQQEVEPGQAGKERRQVGLAALEEIAQVEGGHAGEDEEYQGEHIGERRGEVAAQLASENGADGGHAGVSRVSWRNTSSSWPCSVRTPDTRQPLPWIRRLSAGRICTPGRARMVRVPARSGRPSIPATPGSMAMASGSTGASMLRLTAWW

SEQ ID NO: 32077 - protein, 186 aa, Pseudomonas aeruginosa
PISFCAWRALSCMSKPKMRTLPALGARKPESIFRVVDLPAPLGPRRPTISPRSMRKLKSFTTVRPEKRLLSLSMSIMVSLEVEPFADMRRGSHERGRLPGVIGWFFQWALFKISYLYCWETSYELSLKDGSYRDFQGSPVAGAAPWFRCGNAAMSRSLVPMLGTRRFPLRSFTREGSCRFDRREAE

SEQ ID NO: 32078 - protein, 182 aa, Pseudomonas aeruginosa
TCTLRSGRRRIRPWPVARRRRSGPGRDGPAALSVGRPAGRLRPRRGGRRAGRGSPSAARAGHGRGSAGGWRAGARHRVRRSGRSGSPASRWRFRFRPAAGAPGRGAGRVPGGRGTRWLPGFPALGGRHRRGSDGRVRPGAGAVRRRAARRRTGRVPCGWPAGSAPAGRRSGSPPAGIPGRRP

SEQ ID NO: 32079 - protein, 613 aa, Pseudomonas aeruginosa
LQDVSVIFPKLVGIKSARTGEISSREGRAMTLQPFAQPPLSLALGAGRDLPGQAARVRAEWLAPRPGRAPAFLLALLWGRGCANVVQAIEGHLDALFADYACTPEGWPEAQAARQVLASLNMQLYRRRREGEPGVLELAVGLLLVHAGGVHFLQCGAVGLLRYRQGSLQRLGGSGQPLGSSAELALVQHNLTQVAGEPLLLAPQPLLEVADLRALGERCAGLATGRLEGVLQPLLHAPGAVALVLPGALERAPAAPRHTGWPALGAACPGDCVDGWTLQAACAFGPPGRLFRACDEQGREALLLLAAVDADEAFWQREWALRRCRAESLPRVLSSPRLRRHAFQLFAPPRWPMRSLLDWAPAHLPLEPQCALVLLEQLMDAVRALQRRGVQGLWLGAAADPAGRGRAPAVPPRGGGDPAGGGAPGAACGQRAAGAGVASRRGARWPGRPVRPGGAVLLAALWSLAVDRLPGERRRMPLRAPGRASGGPAGRLGWGIGAGPGAASGGALRSVVGILAGLAEAASASPAGLRATPVATGRAGPGPAPGRGCAAGRPGRLTDRRPACGSARCVRGVLRRSVVPAGRCDASGAGCGRGWRQGRRRGRVFSAPVHRAA

SEQ ID NO: 32080 - protein, 170 aa, Pseudomonas aeruginosa
LVTEADAPVGLGEDSHPLQPVLEFRRRLQAQRLARIEGVVEGGGLVVEHHVVGAGNAHDEVDPGDAQQGQEHVHVVLVGLGMVGVADVATHRHAEQLAAEVVFQAGADDLLAVVQVLGTDEADHGVHQERLEVTSHRIGAGLAGLLVDAVVGVGRERAALAGLEVHQVVA

SEQ ID NO: 32081 - protein, 366 aa, Pseudomonas aeruginosa
GAALLAEPGLVAFLEDLQADAEAGIGRLGAGDRLEHQVQRHAAVDRLDGAGDVGQHAGLGRNLVALDDRVEHLQQGADRGHAVGGRIDPEHRVAIAEQQAVEDARGDSGRVVGRVVWLQAGGEPAAKAEGVAEAGDHADLLRHQDQVLDTHDLRYRRCHFRRQARSQGAQAGLVGGVAEQPVAEAADGEMGHRGEGVALVGVDDQAGDLVVLVGNQRLVEEVFERDVGQGHLRGDPLAVVARRDAGEEIAGARGAGLGHHVLEAVEAVGFAADAMGETCHVCLQCPASPCGGPGFVVVALSAGPVPPPGSRRTLLPGCRTPGDADCTGRSSRSVQRRSPPRRPRPAGRPGSRRPPRRRPAPGIRRR

SEQ ID NO: 32082 - protein, 708 aa, Pseudomonas aeruginosa
GSSKTARRARSTCTGTWWPSAGWRGTSRPSRPGPGRSSSRRSRRRSRRRRRARPAGPSRRRLSSVDGVGSSRRRRFRSRPRKLRAHGRFVRGTWVFHLNLVVIDPGFPGGVLYVVNAGNSYASRSAIGLARRWKGRRRQPRRRVSRAGATAPGKSGRGRSGVLLEEAQRVDVVAHQQVLGLLVVVEHHLVRLATDAGLLVAAERGVGRVQVVAVGPHATGLDPAAHAVGAVDVAGPEAGAEAVLGVVGDGQGLGFVLEGGDSDHRAEDFLLEHAHAVVPLEQGRLDVVAAGQVAFELLDAAAGEQLGAFLLGDVEVGEDLLVLLLGSLGADHGLGVQRVAALDRPDLFQHLFHECRVDRLLDQRAGRAGAHLALVEEGQHQALGGLLDERRLGLHDVFEIDVRALAAQLDGGGNDVLRRALEDVRADRGGTGEGDLGDALAGGQGLAGLPAEALDDVEHARRQQVADEFQQHADAQRGLLGRLEHHAVAGGQRRGQLPGGHQQREVPRDDLPDHAQRLMDVVGHGAVVDLGGGAFLGADAAGEVAEVVGGQGDVGVEGLAHGLAVVPGLGDGEQFQVLLDAVGDLQQDVRTLLHRGTAPGVGGGVGGVEGLVDVLGGGTGELGDRLAVHRRGVGEVLALDRRHELAADVVAVARLEGNDGTGGSGRCVNHGEALLCGRSAVARRTRARAPRSAAKGRARHSSTCTLSR

SEQ ID NO: 32083 - protein, 169 aa, Pseudomonas aeruginosa
RPAARWSARASARRCRNRGRSMARRWKYRRRSSAARTGTRWPTARTPACSTCRPTTGRKTTGPRRSAIRRAAPTLAWASGSSACTTTTSAACAPWTRSAARWSGNTRNTCRSGPGCWPPPATWCSPAPATATSRPSTRRAARSCGNSRPAAASSRHRSPGNRTASSTSA

SEQ ID NO: 32084 - protein, 635 aa, Pseudomonas aeruginosa
PGRWPRAVPSGYSSCPAGTTAPPAADPRAAPCEARLSPPAEYPDEDLPPLRRPARRRPGPGRRRHRRRPRHRRLPPGARRALRQGRPARRRPAQPRPRPHRPGRRRSLRRRPASRQARPGQPGKSQPAWCRPHPCQPAASQPARGRPLRRQGGGDPGLGPVRPGRPVARRRPHRRLPGVRPSQRRPPAPGHAARRRPGDDLAVPRRSQGRRPARRQPAGSQAGRGQPGRCRPARQQGALRQLPGQQHAGLQGLPRGLAVKRRTAATAPLAEAAASLLGERQRQAQPQHAAVDGPVHQFRLGTHLQLLLEQADMVGHGLGAYPQVLGHLAQGQATREQAEDLELATGQPAQRCPALLFPRLAGQARGQGLLQIELAGEHSPYRLQQHRRRRSLGHVAAGTGIQRLAHQGQFVMEAEEQHTQLRQALAQPASQFQAADARQAEIDDDQRRNFPLHRLQGFFAVAGLVHLHVGEQPAQQRGQPFADHEMIVHQQDLHRPLLSVVAFQRHPQAQRQALSGTAAQAQFSAQAARALAHRVQAEAGCRVRRAAATVVAYAQVEKAATALQADPHAAGAGMPGDVVQRLLQQAVEMGPGRRIQGRQRTAQAQLAGDALAFLPVRHAGAQRLVQRLALQGRRR

SEQ ID NO: 32085 - protein, 517 aa, Pseudomonas aeruginosa
QRPGPDPGTRRPRPDPARPEHARHARPQRPDEPAQRGPDHSRGYRLRRAGQAGGATGHHLRRGGLHHQVLATRADDRSHRADPQRQRLPALGRDPHPEEFAATQRPRRTRHLPGTAPGPDPQAAAGAGADDQGRVEQADRLQPGHRRDHGEGARLGDPAQAQGTQPGPGDPQRRRHRLRRLPAPLRPADARPPYPAAHCPGDAGLRRQFAALPRGAEGHRHRRGQFHRPASLLRRPHARHPAASAPGPGHARARRLARGGGAVRLRGRVLLRLRAAGRRHRRAAAIRRGTGHPAAGRPAARRTAGRTGAARFPAGPGRPAVPVAPRSQRAAAGRCPADAPVRPRLGPLYPARPRRRRSAGGQRGQLPACPCLRRPAAPGIPRAVAAGRRRAGLCPAFRRPRLRPRLRRLVQRTAGADGDPGRLGAAQRAGARRPLRRPAARRAARPAIAAGDPGGARRDRPDPRPAPGPRGARRRLNQTEASRSSKWQSAVFSFIGRTGLCIRVWPSSRTCCLSSLL

SEQ ID NO: 32086 - protein, 534 aa, Pseudomonas aeruginosa
ASSLCAALDSMRPISAWLIRCNLCRSSSRATTRACSSATDTSAGSANGDPGEGLVDMHAIELLSVGVEADHLLAAEKRGGSLRVTADLQLQAPQEAVATDGQQRRSEALVEAAELRLQVGQQRTGAHRGENDAVLHRTVERQAQVLVGLLDRAHVIAFVDPHRQRMRGEQGEIQRLRCHPDQPGVFQRRRLGVEFVDPPAAAVGAGHHQLFGARHHVMGGEDLEVQPGVDQHHHCRPCMELALVVDMGVGQVAVVAGRATEVRDRAERRAKRGEHHLFAAGQAVEQGQGEAVVLDRRQAAAATAGHQGLDHLLRVQQAEALHFVDQRAADGEAAHVEAHRADAAAPVARRSDLAGCGAADQVDTAEVAFEHLGKGRQVVFRGTEEQHEAQVRMDKLARQVLGHHFDVARAGHAPADPFPLPFVHARSPVVPPRQHSTKGAAAAPILLGSRRGPSKVSVSPVQYGAERHGVGVLVERGTVAPVDPVAVQLGDQLEVVVDRAEIGDAATLVVGRGTQAVAVVDGLAVGQRQAVLAP

SEQ ID NO: 32087 - protein, 143 aa, Pseudomonas aeruginosa
RRSDAGKAVVELPRGSLQRRLESTHQPPRASSNRAWAASRSSPLRPRAASASSRERPAPPPRCSAQARRARSAKLPGARRRSSARASRRPARRRAGSCASASAERWRKVSICSSRRTGQARGDCAANSRPRRAPTSRKPQNNA

SEQ ID NO: 32088 - protein, 345 aa, Pseudomonas aeruginosa
PSCSSSRRRRWKAGSCRRASKRQAASIGTSCVGSGQNSSNADSPSMASSRRCRPGLGGRGSRRSPAAWPGIHRGSGIAACMTKASQRVRRQSSTSASGSPSRPGKASSNCRIGRPVALRRRSAEDRRSPLARQSGGAARSRARAGRTAASRRSRGPSRLSDQSSPSASRPISTPPRRAWPHSGRNAWRSARKRDRAGTPGKRQRRNSAPSAAALGGNGSSKRQACRCAASGGAAATGATLRRKPADQRASAPSSSLSRCSRRQRSARSASRQAGRISAGRPRTRWRSRSSGAVGSASNGRRAASRLAASSRRSPSQSKKAASSAAAALPSNSSKVNARSACRASR

SEQ ID NO: 32089 - protein, 199 aa, Pseudomonas aeruginosa
WAAWNSRRARWNASFSRARLSRRPAAKRRRGVSGGQAEGQRRVDQGLLVGRARQVFGLEYFALAPLRIDVQQGAGEHVDQPCQTGANVLRRHLEEIVGGPAPGAGVDLAAAHLQPRHQALVAGKRRAAEKRQVLEEVGQAGMRARLVVAARRHPQPGSGARCRRIMRQVQAQAVGQHAGAAPGVVLGVAIHGRPRGFRG

SEQ ID NO: 32090 - protein, 131 aa, Pseudomonas aeruginosa
APAGPPAHGTGRTGRGRDRRRRCALPAGRASSGTGCPGTAPRCCAGAGSHCRGRRRSGSRARTRPACRRASAGPAPAGKACHAGRGCTRRATRHGRRGRACRYRCALRSCAAGRSGWPARGRCTAGCCRSR

SEQ ID NO: 32091 - protein, 532 aa, Pseudomonas aeruginosa
VKKLISTANITMQFGAKPLFENVSVKFGNGNRYGLIGANGCGKSTFMKILGNDLEPSAGQVMLEPNVRLGKLRQDQFAYEDFSVIDTVIMGHEELWAVKAERDRIYSLPEMSEADGMAVAELEVQFAEFDGYTAESRAGELLLGLGIPLEQHFGPMSAVAPGWKLRVLLAQALFSDPDVLLLDEPTNHLDINTIRWLEGVLTARNSTMIIISHDRHFLNSVCTHMADLDYGELRLFPGNYDEYMTAAEQARERLLSDNAKKKAQIAELQSFVSRFSANASKAKQATSRARQIDKIQLEEVKPSSRVSPFIRFEQYKKLHRQAVTVENISKGYDGKPLFKGLSLQVEAGERVAIIGPNGIGKTTLLRCLVGDLPVDGGEVKWTDSADVGYFAQDHADDFADDMSLFDWMAQWTQGGEQLVRGTLGRMLFSNDEIKKSVKVISGGEQGRMLFGRLILKRPNVLVMDEPTNHLDMESIEALNLALDNYPGTLIFVSHDREFVSSLATRIIELGENGVTDFSGSYDDYLRSQGVIV

SEQ ID NO: 32092 - protein, 356 aa, Pseudomonas aeruginosa
KWGIAVWRSSGLHPTGKANRRLVGRNMTIRPTHRTICFSPQRSACMPHDLNDLYYFAKVVECGGFAAAGRETGIPKSRLSRRIAELEERLQVRLLHRTTRKLALTEVGERYLQHCRNLLLEAEMAEQVIAELSVEPRGRLRLSAPVAMASSNLADLLPRFLERHPQVQLEILLTNRRVDLLNEGVDVALRVRELGDEDPALVCRRLAPATTQILAAPSLIAGRRLEHPEDLEDLPFLGAIHNDRKVHATLIGPDGSRYQLEREPRLGVDDFVLRKKAAVAGLGVTLLPEGYCDRELADGSLVRILPQWTLPKSTMQAAYLPRSSQIPAIRALIDFLVEALQRPSGETGPAYRRARE

SEQ ID NO: 32093 - protein, 213 aa, Pseudomonas aeruginosa
AAPFSRSAATARRTGARRAGCRARTAGAAGRCPRTPVGTRACGSCGGIPAARPARQASRRAARTGAGGPPGYASRRVRRCACPASRGRMRAGWPADRPAAARGPVRPGTSARRQRPAARRGSAGPAASPTGAATRSAESAPAAPGPASPAPGRHGGQLADRWSARPAAPSRRAGGPGRPGWRETTPGRPGGDGGRRGTRRYAGRLLPRRSSAG

SEQ ID NO: 32094 - protein, 194 aa, Pseudomonas aeruginosa
GPSVSPLELFAASLGAIAVYLTVRQNPWCWPIGLVMVALYAWIFFEVKLYSDMLLQMVYAALQLYGWWQWTRGGQDHDGRSVSRLNAAQRLYGLGAGLVGSVALGYLMANHTDAASPWWDAGLTAFSLVAQCWMAQKRLECWALWIAVDVLFVALFASKALYLTAALYALFTLLAIHGWRTWRRDPALREGVAA

SEQ ID NO: 32095 - protein, 418 aa, Pseudomonas aeruginosa
NSSGRFPGRLDPMVGGPAVARMQHCPPDSPGAHLQALDGQGKRKTGTPHARSLPTLIRAQRQRRKRHHVGEFATHRRSSAAGHRRLRAGEPPRACGGRYDRRPAPGPATGRLPSEHGARPTSHRRRHQRLRRGRRPRQRGGQRQYREPRTGRCRLRHRDQRFRDSQHDSPRWRPAGFRQPAGEPGDGPGRRQPRHHPRRGRRRRRRPRRADQRQPQAGPGTAADARGWSMKRLSALLLAFACIASLQADPLASRNRASIDDSGTYRGNFALNQAAGDAQQQSNVRVVAVGSAALVGSDQRQHLQLDASQPIAASASISGAALRGSGILGVNQGAGLGNQQINAFRLSLSNGPESLDDSVLAQSVALTKVSGSATPVPGGRSVSTDDRAFAGSSGVVQVNQSAGVGNQSMNTLSVRVME

SEQ ID NO: 32096 - protein, 339 aa, Pseudomonas aeruginosa
KRLWSRPRWPWQWLQCCRYRHTPGNEGGWHPPKPNPQSNNKGGATALVVDTQQNYNNKVSNFGTLNNASVSGSIKDASGNVGVNVAAGDNNQQANAAALASADASFVFGTATASTSVLQSGYGNTLNNYSNPNTASLSNSANNVSGNLGVNVAAGNFNQQKNDLAAAVSNGQYSTAGSAASQTSTGNTTVNSANYAYGGTYVSLKLNADGSYKGTSDQIGDVYLDTWEGQTHPGGSNTGHIDVDSQAQGAKDLNHDGGAFAFKEKGDVDLKGTVSGFIPAIVGFKTPVTNNASLSNSLQNVSGNVGVNIAAGGGNQQSNSLSIAAGCSSCPAGGESLGF

SEQ ID NO: 32097 - protein, 161 aa, Pseudomonas aeruginosa
  UNSURE (36),(38): Identity of amino acid at the above locations are unknown.
AAPGRTPAARSSARASTCRCGRTWRARSSTSPWSIXQXTPHHPPPATARSSAAPDWHRPKGSARASAPPATTTAPAMASASRSATATRRRHCRAARRWKVRSPSAARPARSRSRRTAAPCNWRSRPAARAPACKASAPAAWCRAWRSAETATWCRTWRRSR

SEQ ID NO: 32098 - protein, 99 aa, Pseudomonas aeruginosa
VSSTTATTITAPVMIRLVGSDAPICASPAANTEMISTPKKVLTTEPRPPIRLVPPITTAAMTWSSRPTPALGSAASRREIWNSAANPASSPIRANTAIL

SEQ ID NO: 32099 - protein, 99 aa, Pseudomonas aeruginosa
ASPRAISSTPRDTMNEGIRQATVIEPVTQPARVAQAIPSIAAGSTPQPQPSVARLTAEAARASTEPTERSMPPTIRMKVMPTASTTRSGIWLAMARKVP

SEQ ID NO: 32100 - protein, 185 aa, Pseudomonas aeruginosa
LPRRRVGAAAAVAEDVGSLISGSLRCVFTTSPAARRVSCNRRRPPPAARPGSRRRARRCPPYVPPRARRCDRRSASARAGRWTPPPAPCPGGSVRRARHRCRTWRRRRCHGSARRTAAPGSRAPASGRSPPSAGCRRTVRPPPARCPRSAPAAPPPGAAPGLPRGAGRSPRGAPAPAGCPGPGWR

SEQ ID NO: 32101 - protein, 162 aa, Pseudomonas aeruginosa
SAPPPGAPSRPANAGSGAAADRRAGPAHRRRGRRRRSGATIRCARSRSVRKCRRSPPRAPRTTPHAPCRAGSAAPPAAAAHRSAVGPGRSARPVRGRPSGSPVGRRRSARSARRRPGGHRATPRCAAKSAPALPGDGRCRRSPRRVRAAARPARRACPPRAR

SEQ ID NO: 32102 - protein, 461 aa, Pseudomonas aeruginosa
FATAGKRRIFYLAGRSPAAHSAQPVLVQQAVEGRPRHPEHPRGHAEVVAVTGQRITHRLALGAELVDLQAGQRRAVAARAFQAEVLGLDLLSLCQDQPATYPVGQFADIARPGVHRHRRQRVLAEAARAAAGLQAVEPGEMLGQQRQVLAPFAQRRGADLQDVEPVVEVLAERPGIDRRLQVDMGRRQHPHVHLDRPATADPLDLLFLEKAQQVGLQLQRQVADLVEEQGAAVGRLDPPDLALVRAGEGALLVAEQLGLDQVLGNRPAVDRDERLVRAPRLPVQGTRDQFLAGAALATDQYRRVGRRQLRQQPAQVAYGQALAEQFVLALGIAGHRAAPAQAGHAKGAAEGHLHPRHVERQGMEVEEPFADEIADTIQRQGVRAEHGDPLGAAAADQVLHRFRPLQVERPQAQQADVASAFARRFQRAAVHCPTRLAKARQQAPAIVARVHHQQTAEVRCI

SEQ ID NO: 32103 - protein, 783 aa, Pseudomonas aeruginosa
IFVYIANAEIVLSVVAATLDFQAPDELLQDQLVKVVAEVDILHPAVDVRVVVHLDHHHLVAGLLQVHPVKAVADQVGGLHRQLHHLARRLVHGHGAEIAADLLGVRAVVVDLPVALGHEVLAGEDRLAVEHADTPVVLGIEELLGKDQHRALEKLGAGCQQLLLVLHLDHPAREAAVGNLQHQREAQALADLLQFLRVLLVENLRGRHAQLVAAQQVGQVHLVGAAQDRHRVVHHHQPFALGLLGETVGVVGDIGGLADEQRVVLGDPRIVLALDQVDVDAEAAADPHEVFQRLGVGRRERLAGVVEDRQIVAERLARTRLAPDLPAEAVQGVGEEVFLVLAQLVDGAGLDALDVPGAVALELHQQQRAGKRLEQLSRQVLQRLDIGTAEIQGQGETIGAAVGVRGQGLVQGAIQIFQDQAVQRLPGQLADGPHRGDHLVPARLGEQRAVVAMAQVLVVPAQVDHLDPLASVVVDGQFQVFLGGDHILAGVIGRPVFLAFHDDEQLAHDTSRGDSETTAHSEPACRRTHPGQYSAGIPCETALWRLPANRSVQHPLQHARAEVPARGRGDRYEPDPPPGRCGRPVRPGRAGKPLLRLRSPVPPQLPVDAHPRPRQPDGSRGRRRRARLRPGAVPRRHLAGPPLLHRHRPARPRHRPRPEAAGSRRAGRAGQRPRLHAPGSAPGQPWRHRPLRAQRLPSLRHRARLLRGPQRSAALRETHPQPRPRTAPPRALLPADHRFHLRPGLPADGHGRAATGAPVDPPRGTAPVARGDHHLHDRRARRL

SEQ ID NO: 32104 - protein, 642 aa, Pseudomonas aeruginosa
RCPKKAYKDVPDAHREKGSAGCRRDRAGGRRGGGLLPRQSQPPPLPGAERGTLPAAMAGRGPPALLLHAPGHPGEGPALRLVHRPRTALLRRTLRRPRIPRPLRLPRRSAAEGQRPQPRQPAGGLQPAPRREDRHPLPGHHLRRLPHRRTALPGQVAAHRRRRRHALHRRHRADPARRRLRPGARREHGRHLLQPVQVQPLRQESPRRTLRTGQVATARRLQGRTRHPPAHRLERHPPPPLPHRGRPRPHRRLRAHRQQRLRRCHRPGQLPRRQRPGELSAGLGHLEIRLGAMERLGHAADGAQYRRGPRRRRAPADLRRARPAAAGRAALRLQRTPARPARPGRNLQQLKPPTWPEDLFGRIDLQRASQGRALFEANCAFCHAPKVQPAEYAAPGRNPEWRMHMVPTEVIGTDPTTADNIADHRYDLRKLGWSVDELARMNVQLIGADPQQLDLSQLSSAKGLAYITALVEQHAYRDAGIPPEQQKTMNGFDLPIGVQELRAYKARPLDGVWATPPFLHNGSVPNLFQLLSPAAERSPQFYVGTFEFDPKFVGFRTEKFPGGFLLDTRLTGNRNSGHEFRDGCRQNGVIGRALSPEERWALVEYLKVLGNPEFERRLVPAQTPPWTPGPKCPAPEQRTAQR

SEQ ID NO: 32105 - protein, 173 aa, Pseudomonas aeruginosa
KPTANAHHQGHPLHARTPHPRLAVPRQMARPPAPPAAGRRPRRLGHRQPLLRLEILRPGVRGRADRPGRSPHHPGDHPGRHPRGRTAPRQHPRPARCPRQGPRLREGRIQGTRRPRPDPASRRVRRSGQKLERLGALLQRQRLPAVRQQERRARHGHQAARRARRKTPARPRP

SEQ ID NO: 32106 - protein, 169 aa, Pseudomonas aeruginosa
RRAGLRHVQPAGVLHPRHRRIPAELRRPGRRQESPGLLPQLEPRQLGTAPPADRPAHPRPRPGQPAARRLQRHLAVQAGRTQHQVPRRPRPGEVPGLRAAEAEPGPAQLPPRRPVPATLHRPRPRLLRLPSAAPGPGQVHAHRRHQRRMEGVGRALRYHSRHHCASSGF

SEQ ID NO: 32107 - protein, 485 aa, Pseudomonas aeruginosa; identical to SEQ ID NO: 24188

SEQ ID NO: 32108 - protein, 151 aa, Pseudomonas aeruginosa
PWTRAVPWDCGARSACCSWPRPESARRGRRCRNRRARRAVRREPHGPGRGRPAGRSGAARARCRCAAASPRSGPVPGSVPGPGQGAGRCTGRGRRTAGGRVRLRRHRRPCRARRRPPSAAGSGDAVPRPPRVPPGPPHSRCRAPGRGRRRC

SEQ ID NO: 32109 - protein, 247 aa, Pseudomonas aeruginosa
RPWPCHKGGRMLDACAAIGRRSPAPRSLEQARHHPRHVLGALADLLHDAGHGGDLVVVLLGAGLDGLHVVVDLLGQLDVLGDHVLDLHRGAAGARRQLPHLVGDHREAAPHVAGASRLDGGVEGQQVGLFGDALDGGDDVLDVLGLVGELGNQADGGVDHRQGLGRQGDGLVEGVDAAGGNLRGLFRGGERQLGGAPYFLVAIDLLGNVDGELDDLDYPPRTVLDRVVGGFDMYPLAGGAAALEMPA

SEQ ID NO: 32110 - protein, 423 aa, Pseudomonas aeruginosa
EFAVPQPSPEIRVLPIELVEAEHAVVLALERLEAVAEETQEVFVGIEYLAVRGELDDRHGLAYGVVDRVEQEQFGMVAGHVGGDLQHLDDRPFGILHREIGGLQPDRRTIAPQALEHAALGRAAGQFLPEAHVGGGGLEVLVAEDPMVLADQLVRRVADHREEQRVGGQYLAIGSETDGGDVLPDGIESPRQVFILGGAFHRPAFSAEEHRARLLDGACPSRGSGEPEIAVLPLNASVDRAPATFLGARIAVRPLAGGTQRGARCQDRQAGQPDYRDALVEAGIGTPRQSPRARASARLRAMPAPVRAMIAAPGLTALRPRAVVSRNPLPGGSTWQSISTRWPNRSRTKRVSCTSSPRWRRTGRKTAASPPPTRRNRSAPARWVGRTAASVASSMPPRPGARTPTTACRAIPGRRMPGGARRS

SEQ ID NO: 32111 - protein, 213 aa, Pseudomonas aeruginosa
CWRASSMNDFKSALAPFPPGYPRVLPGNRRQVPILHRDADFLLRALQPDDFVRTSRYENANREHLAPWEPLRDPGYFSVDNARARTLLQVASMDEGEALLLLLLDPDDGEVLGRCSYTNIVRGVFQACHLGFSLAAAAQGRGLMARALRVANRYCFEQLGLHRIMASHLPRNARSERLLESLGFEKEGYARAYLKIAGVWEDHVLRALVDAPR

SEQ ID NO: 32112 - protein, 161 aa, Pseudomonas aeruginosa
PGPARRPCRPAGGRGCSDTVPALAPGRCAGRPPGGWRPGPGCLPGRRSRWRPASSAVRSVAGCRRARRRSSMPAAGRGPGSARRSAPTPRPGRRGGARSGRRAAAGGPAGRACRTRRPCPCPATGRSADRSAPASPGGRGPWPRRPPRTVVPSSAGTADRR

SEQ ID NO: 32113 - protein, 207 aa, Pseudomonas aeruginosa
PRARAGAPGSPRQRCPGCTGRTPAGRRASAAGSRPPPARGPCRVAIPGCHGCRNGSARRRRNPRGRTGRPPGRDGPAAPRCRGRPRPDGRHAAAAATAADYPGAPPGTRSVAGRRYRARPNVDAGRPSARASPRAGPPAAPRASAGRRPAAGSRRGRRDTARPGSAAGSSRRAGAGRYRSARFRRSSQPGSRPPAALRRDGPGWPVH

SEQ ID NO: 32114 - protein, 223 aa, Pseudomonas aeruginosa
PAPGHRRQRRTSSTPPDRCRRTTPPAAPGRAARYAATVRRWRRSGRRRWRRAGSGRRCAGHRWPSARRPRPGSRRGRRTAPVRRDDRSRPAPGAAAPATRRRAGRHASVGPPRTAGAGWLRRRSRSSRPGARPAPPAGCRSPEDRRRRGSRVASRLASARPAPPRPGRDRSAAACRGSAGCRRPATRRAAPRRCRGAGRATRHRPRAPNRLGAGACPGGRNRC

SEQ ID NO: 32115 - protein, 441 aa, Pseudomonas aeruginosa
  UNSURE (31): Identity of amino acid at the above locations are unknown.
LLQARRIVAAADAGAQGQRIGKVVQQVQARXAFPAERLVLVEAAAEGQRPVRAEGDLVLQEQRLVSRAGVAGGIHRAILQFFLAPFAAEGEEMSLEGRHAEVAVDHAVGKPLRVARRLSVGTRVVPLQAVAVGAQLAATPVPLAIVGERPALAFDHVARLVVARARPSGLAVAPASFAPALVAEVDALGVVRGPAEVQPTAVGVAAFQLGESALIGVRGFLLAAALAVQGEAQLAGHQRPGEIGAELVALPTEAVLAHAAIEQTAAHPGIGGAPGDHVHHPAEGFRTVERGHRPAYHLDALDALHRPPAEVEVGMGDGPGRGGDPLAVHQHQGVLAGHAANADAPPGHADAVELQAFRTAQGFLQVAHRAPPQVLGGDQRNAGRGVAQLALGSGGADHGRLQVDRRGQRQAGKQVEERHGAGQPQRRKTVRGGMGGHGRQV

SEQ ID NO: 32116 - protein, 156 aa, Pseudomonas aeruginosa
PQPSRSWRSSNAGTASRRATSASARSATRRCSSCSKTSSAATGASPPSTPPAARAPSAGACSNASRRRGWWRWTPTSCCWRSRVRRWPVSPNGSAWWSATSPIQAGPNGSPKRASPSPANGPRRCSLPPRCTGCRPPNSPGSTPRPASCSPPAACC

SEQ ID NO: 32117 - protein, 786 aa, Pseudomonas aeruginosa
RRSATPISRGARSGAPAKTKTARSISISPPCARRASPRPPRSGSSWTTTSSSPASPRPDTPSAGHGEYLQWNPGNPPDVDADQRRLGVARQNPQHLVVLQNQNTSCCGEVEMTQPRKATWPATLLKRNGREVPFDPGKIERAIAAAGQATGEFDPQQAQALAERVVERLPERACLDIERVQDLVERVLMEAGHYPTARAYVVYRERHGRLRRERKTLVDVAASMNEYLSREDWRVRANANQGYSLGGLILNVSGKVTANYWLDEVYDADIAAAHRDADLHIHDLDMLAGYCAGWSLRTLLNEGLNGVPGRVEAGPPKHLGSALGQMVNFLGTLQNEWAGAQAFSSFDTYLAPYVRKDRLDYASVRQALQEFIYNLNVPSRWGTQTPFTNLTFDWVCPDDLRDQVPRIGGEEMPFAYGELQAEMDLINRAYIEVMQAGDAHGRVFTFPIPTYNITHDFPWDSDNATRLFEMTARYGLPYFQNFLNSDMQPNQVRSMCCRLQLDVRELLKRGNGLFGSAEQTGSLGVVTINCARLGYRHRGDAAGLYRQLDHLLELAFASLELKRKVIQQHMDAGLYPYTRRYLGTLRNHFSTIGVNGLHEMVRNFSDDREGLHSEAGREMALALLDHVRARLVGFQEDSGHLYNLEATPAEGTTYRFAREDRKRYPRILQAGTPEAPYYTNSSQLPVGFTDDPFEALELQDALQCKYTGGTVLHLYMAERISSAEACKTLVRTALGRFRLPYLTVTPTFSICPRHGYLAGEHEFCPKCDEELLQRSTPKSCCGGCGG

SEQ ID NO: 32118 - protein, 294 aa, Pseudomonas aeruginosa
VACRSFHPPARSTTDEPQPVARRPAPALRSLDPRDGLPPSRGSVQCRQAVRASRTPPFPRDAMSATLRVGGLVPLTTLDYPGLLACVLFCQGCAWRCRYCHNPELIAPRGAEEIPWPRLLDFLRRRQGLLQAVVFSGGEATLQAALGDAMRTVRELGFRVGLHSAGINPRAFARVLAQSDWVGFDVKAPAEDVAAITGVDGSGAANWRSLECLLDSGVAYECRTTVHWRLFDSERLWRLATRLREMGVERFAVQLARPARQLDPQLLAKPAPQGAAQLWRELEELFPAFELRDA

SEQ ID NO: 32119 - protein, 486 aa, Pseudomonas aeruginosa
QRKQEMGMREANDNASGLKAHPLGSLETIAIIIGTNIGAGVLSMAYAARKVGYVQVAWYAWPLNCPCRIVTRLLRDRSLPENPRQQPAQRPLPALPGPARRMADFHRGGGQQIRGHGRLHDRQRQHHGRVIRPVRPHARGRQPDLVSPLGAGAIPGPEGARRGREADQRRHGGHRLHPHRRYPDAGRRPSRPPLAEPVAIRGSSVQPGGLRVRRAVPGSGVGARQPGNPRARAAPDRGRHAADLLGWWRPFLPSVIAPGRPGRHQRGGDLELGTLLRPMGLLRGEHFRLVGDADLVLGTRRVPVHQYLRPLPRGQRNPRAQTPGGARRGLGPAVPAGLCGARRLRERAVLRRYLRRRTDGHHPHPPAQRGAAPRRPTAGIQLRLVCPSADTGADRPGVRLQRGLRDRLGTGDAARQLVTGRAACARGDYTEGPCLEFPGHAAEHPPPDRPPRTPFAPAERSRRPRPPGSLGACLRTRRPHRMARRG

SEQ ID NO: 32120 - protein, 179 aa, Pseudomonas aeruginosa
DSFSITTAIPSMPPADASLHDAVSHLYQDHHGWLQGWLRRRLGCAENAADLAQDTFARLLASRRVLDAREPRAYLTTVAKGLMINWFQRQSLERAYLDALANLPEDLAPPPEQRLMVLETLHEVDALLGSLPDRVRQAFLLAQIEGLKYEAIAERLGVSLGSVKRYMQQAFRQCLELME

SEQ ID NO: 32121 - protein, 835 aa, Pseudomonas aeruginosa
PPRPETFFLLGWQVEESAPTQGPQRPRGTLYMPVRTLRPRSLSLAIHAAAMTLALAGAAPALLAAEAPAASSARSYDIAPGPLGRTLSAFASDNGVSLAFDPALTEGRRSAALRGRYAPVEALHRLLLGSGLELQQRSDGSYTLVPATTDGALELQSSLITAQAAGAETLPAEYAGGQVARGARLGMLGNADVMDAPFSITSYTARTIEQQQARSVADLLQANDPSVRVVGGRGDLVDSYTIRGFSVQNADVAFNGLYGLLPFWRVPIEFAERVEVLKGPNALLGGISPGGSVGGTINLVPKRADDQPLTRVSVDWTQRSQLGTHLDIGRRFGENNAFGVRFNGVYRNGDTAVDHQSREFPMLSLGLDFRGERLRLSSDLLYQKESLEGVVRPLLTGPGTTHIPHAPDSKTRFGLRDSYLDQEDYSMVNRGEYDLADNLTAFASIGGRQSNYETIAANSILVGNQGDIVNSLARQRGDRRTYSAEVGLRGNFDTGPLRHDWTLSANRLHERLGMVYAFTGMQPGNLYQTSPHTPLPDFSSLDGSIPKTNETDLGGVALADRLSFLDDRVQVTLGVRRQQIESRNYDQTSGARTSHDKRHVWTPMASVLVKPLQDLSLYANYIQGLSQGEAAPMTAANAGQVLAPYKAEQYEIGAKYDLGGFTTTLALFEIRKPNAYTDASNVFRADGEQRNRGVELSLYGEPLDGVRVMAGATYIKPEQNKTGDPASEGKDAPGVARRQANLGVSWDTPFVDGLTLDSRWIYTGSAYVDSANALAVPHWNRVDLGAAYAFQVAGKPLVARANLENALGKDYWTAANGYLSISSPRTLSLSLTADF

SEQ ID NO: 32122 - protein, 447 aa, Pseudomonas aeruginosa
PANDRENPAHLVPGAQMDQPDLHDLPADALPHRVAADLPRGDRALLRAASAARAAHRRVAAHRLRRRDRPRPGRPAGRSGALPGIRKGRPAGPGDQRAEPGTAAGERPHAAVRRAHRGILRRTTAAGRLHVPDAEAAHRPVPRPARLPVPRPDGPAAGGLAGVRGGGIHAVHAQAGLRHGTRRTQPSPEVAGPAQPAGHRHPVLGTGGRRDRSDQHPGPADPDALARRAVGGNDRALQGRAAATAPRLARRGPGHGTPGGAGHGGQLRRLPRHPVQQPASLCGVHARQHAAHRAPAEAGTDRRAERRTHRHARDAAVREDAPAVAAAALRRLRRHAAEDRLGAARPRQHRHPRQRSLPLARPTQDAIGEAPGGTAGRQPGDGGQGMRRGLWMIFRWPLLLALLGLFGLLSALLGDGLYDLLSWLALGTPLVLVGWVWLRLPRTRRNP

SEQ ID NO: 32123 - protein, 369 aa, Pseudomonas aeruginosa
DDHPAALRQHPGPASADVGDLRLHPRGDVLRRPGRPARPQARPGALAGRRRGDRRRHRLDARGAALGHRQRPAWATADTARRAGRLRPLLSLALPVHRARPALDVADPARLRRYCSPARPRRRFIRRGAGLHGGTGGRSRRGATTRRGAGRTRRGQRDRHGDRAGAGRTAGDSRAGPAVAGHRRAAPGRPAGALALAAARGASPAEPRRRPGDRRPPPAAAAGGGLRGDVQRHRGADHRGLLRPRPAAPGFRRRRAGGRHRPDRSGRRADPGPAPGAPPGLATAATDPGRRAGRRHRLRRRVLRRLAAAALAGLLRRRGGHGLGIPGSLGAQRQCRARRGTGCRRRHPGGRTWLRPDQRAAARHAAPPI

SEQ ID NO: 32124 - protein, 579 aa, Pseudomonas aeruginosa
QPRPLRAGRSAAGAGGVLAEPTDAPRGNEERSTMTAVDLLLVATLLAALLAWWIPALPGRRGLLALASTLALGAGLYAVWDDRWQAGVGAFAGFSLLLGACLRRKPVRGLPFRTGSLYGLLVLLAIAALYLFPVAPLPAPSGPYAVGVRDFELDDPSRPGLLGAPAGQPRRLLVRAWYPARPIAGAAPRHYFDPDEARSTARGFGEILGFPPLLAYLKHLRTNSYPDAPLRDDSARLPVVFYSHGYSAFAGGNWTLMEELASHGYAVYAIQHSGDASPTRLPNGTLLPMDPGLVEHLRRAAHDGLPQAMRQGYVSDDLDQRLDGQLHTALDLPAPANRAVNLSAPVWLADRLFVHDRLQAGEVPDRVADLVAASDFEHTGEMGMSFGGSTTGAVCMVDRRCAAAVNLDGGDFDFAPFDSDFPAPLLMLHADLGNFYRLFGIEPPARPRSFNDFSYERFEHAGQRQDIHRLILRDSAHAGLTDNPLFIRRPLRDGLLGSAPTEVLIQAPNALVLGFFDHYLRGRANDFPQAQMARFPAWLTRYDNSAVRDWWLAKPEAQRLALRQRIDEMKRRKTGLDLP

SEQ ID NO: 32125 - protein, 186 aa, Pseudomonas aeruginosa
CIQRNTIANVGYIRVSTTDQNTERQLEGLAMDKTFTDKVSGATTNRPQLQAMLEFVREGDVIHVHSIDRLARSLVDLLALVREQTARGVHIHFHKEALLFTGESNPTQELMLSIMDSVAQFERAMIKERQKEGIAKAKQKGVYKGRVKTVDDAAIRAHVAAGNSIRKTAEAFGVNPSTVQRAMKAE

SEQ ID NO: 32126 - protein, 62 aa, Pseudomonas aeruginosa
SAPTYFRFTGVQASPLCCGLNASDVHRSYFPSRTPEHPTSCACAISYKIFEGFCWKLPVLLL

SEQ ID NO: 32127 - protein, 82 aa, Pseudomonas aeruginosa
KQCINITHKSFFRKKLSYRRKLPPKLPLRKNQYFIQSILSIEIRMPNIIRLFGYSSTKFCQETNNSSTFSLIIPKENSESIQ

SEQ ID NO: 32128 - protein, 77 aa, Pseudomonas aeruginosa
RTIRFLNQFQYLLCHWSRSIFFGNFIDSCEHFSPTCLIFHGKSLYSIKLIFCEAIAPLTHNNPPFFLEERNTRFENR

SEQ ID NO: 32129 - protein, 247 aa, Pseudomonas aeruginosa
TTHTSPHRDGRRRRSGNRCRRTASPETRGPGRAGSPRRRFPRPAPCSCRRSAPKPGHCNAAGCAAARSNPRRRRTAPPMRARPATAAFLPCPSLTPVFGNLSQQRRRFSGRRRARRTVSAGRLRRAPSRPARWPWPASSRRRARRPRSGSWPTPSRPPWRRALPACPWPRPGSSPPGCRSAPRSARPEAGLRPPCARSANACRTHATAPRWPGHAARWPARRRNRAGFSPLARADAPPGVDRASRRG

SEQ ID NO: 32130 - protein, 103 aa, Pseudomonas aeruginosa
TARLMHGHAHQLIGHFHGDLVVGDIDELHLFRHLLHQSRITSDVGIVQWRIDFVEHAERRRVQLEDGEYQRQRGQRLFPAGQQVDGAVLLARRARHDRHTGIE

SEQ ID NO: 32131 - protein, 1133 aa, Pseudomonas aeruginosa
IFAGKFQICRTAAEYLREQCLKASIDLVEGFLETIAGFPVDLADDVFQRLQRFGQVVVLRVQVALALGLLLVLLDRRQVDRPQTLDARRETLETLLPIAFAGIQGQVGQYRMQVVAVFGELLLQGFAPHHQPLPLQALLLQLATQQLRLLLGLAAALLHLAQFAIGVFQGQPRLLEFVLDGHPPLQQLLELHAQLFQRCRPLLQIEVELFATLVEARRLLVEALQGLLGGIVLRLQRADPHRQLVRMVLVGAGILANPVEPFAQGVTLRQQGFPALGVQRHAIQRFLQGQARLAQLLLFQRALLGQFRHFFVETAATQYQLLDLGLLRGQLRLQLAVPAPLLLDLAPHLLARAFQLALLVAGRSQTLLAFGDTGFQGLPPLLQRLQFLGAGDHAALGLVAAPDPQEVPADPVAIATDQALAVVQGAALGERLFQGLHRFHPGQPGTQVGVGADLVQQRTGRRRGSASGAEQAQLALAEAGQGEPVEAVQQDRLQIRAEHGLHRQLPTRLDTQAFGEARTLFQALLAQPLQGALSGIESGLLQGLQRSDAPVQALQLALRLVLFGGQLLQFLAQLFESLGLALLLQLQFFQGQFGDRHLFVEFEDRRVLGVGRQLATLLLQAPLAILQALQALLQVLDARLLHLGLAAGFGALLVEGIPLLLPGLHALLGLFQGDARFFRGGRAEFLFRCEHGHFLGQGREQGTVMPEVRFGFLAGPFGFAQVVLQLALALLAMLDALLDPGDVAADRIEACLHLVEAFGQLVMAVAQPFDAGIGTALLGHQGLEGDLLVADDPLALTDLLVQVAPAHGAQLGFELALLGLVLLVFFRRLGLPVQAFQLPPQLFAQVGEACQVFLGPTDAAFGFAAALLVLGNARGFLDEVAQVFRTRLDQLGDHALFDDRVAARPQAGAEEDVGDVAPPALGAVEEIGVLPIPRDPPANGYLGVLGVFAHQCGLGVVEDQLDARLAHRLAGIRAVEDDIGHRLAAQVLRRAFAHHPAHRVDDVRLAAAVRPYHCRHVAGEVHRGRIDEGLEPRQLDALQAHACAPARVAISVRRARPAPAGSCGGRIPAGPRGSSPRHGRSPLAGAEQNCRGTGSFPPCAVPAPGGRRDSPPAAGFRRSPAGRDCSRKERPRA

SEQ ID NO: 32132 - protein, 140 aa, Pseudomonas aeruginosa
SPSARRSSCAAANGAASCRWRSTSSTTRSPPAKKASSSRRSWSRVPGPARRSRPTRSPSASTTIFPRSAPPSASTWKMAGSSAPGSPSAAWRRFPSAPPPAKRRCKARAWKPPASNAPPPPWRTTSPRSATSARARNIAC

SEQ ID NO: 32133 - protein, 801 aa, Pseudomonas aeruginosa
PPMSNHRKPHKSQEELADLFRAELTTGVGRSVKHESAPKHVSGEAIYIDDRLEFPNQLHVYARLSERAHARITRLDVTPCYQFPGVAIALTAADVPGQLDIGPVVAGDPLLADGKVEYVGQMVLAVAADSLETARKAAMAAIVEYEDLEPVLDVVEALRKRHFVLDSHQHRIGDSAAALAGAPHRLQGTLHIGGQEHFYLETQISSVMPSEDGGMIVYCSTQNPTEVQKLVAEVLGVSFNRIVIDMRRMGGGFGGKETQAAAPACLCAVVAYHTGRPAKMRLPRMEDMQITGKRHPFYVEYDVGFDDDGRLHGIQIDLAGNCGYSPDLSGSIVDRAMFHSDNAYFLGNATINGHRCKTNTASNTAYRGFGGPQGMVAIEEIMDAVARSLGKDPLEVRKLNYYGKNERNVTHYHQTVEHNLLAEMTAELEASSEYARRREEIRAFNAASPVLKKGLALTPVKFGISFTATFLNQAGALIHIYTDGSIHLNHGGTEMGQGLNTKVAQVVAEVFQVDVERIQITATNTDKVPNTSPTAASSGTDLNGKAAQNAAETIKRRLVEFAARHWKVSEEDVEFRNNQVRIRELILPFEELVQQAYFGQVSLSSTGFYRTPKIFYDREQARGRPFYYFAYGAACSEVIVDTLTGEYRMLRTDILHDVGDSLNPAIDIGQVEGGFVQGMGWLTMEELVWNAKGKLMTSGPASYKIPAVADMPLDLRVKLLENRKNPEQTVFHSKAVGEPPFMLGISVWCAIKDAVASLADYRAQPAIDAPATPERVLWGVEQMRRLKTAQAQAADAAVEPA

SEQ ID NO: 32134 - protein, 247 aa, Pseudomonas aeruginosa
SSAGTARAVCSYAVTPRFAPTSTAEQLDMAARLLREHPGVYLHTHLSENLKEIEWVKELFPERSGYLDVYDHHGLLGPRSVFAHGVHLCDGECQRLAETGSPVAFCRTSNLFLGSGLFDVPKLERYKVKVGLGTDVGAGTSFSQLQSLNEAYKVMQLQGARLDPFKSLYLATLGGARALELDDRIGSFATGNEADFVVLDYHATPLLSYRLSQAGSLAERLFALTILGDDRTVKETFAAGRSVHRRD

SEQ ID NO: 32135 - protein, 599 aa, Pseudomonas aeruginosa
PTGPQDLTTRAMRSTCCGKHQTRRTRDLRCDTARHRPARTPVQAPPAWYDGQDRAGGRADHLHHHGLHHLRQSQHHGRRRHRPRRGVRRHVPGSRPRLLPDGPVRQLAGGPGAGNGTERLLHLHRGRHHGLQLADRPGRGVHLRGDVHAADLLPGPRMAAQQHPPQPQVRHGCGSRPVPRPDRPEDRRHRGGQPGDPDQARPPHLARPAAGGTVLPDDRRARVPPGVRRHPHQHPQRHPGRLGPRPGAVRRGVLGAAEPGADLPGDGHRRRVQRHHDQRDPGLPLRAHVRYRRHSHGRRPARAPGEGGRAHREPVESDEGRQRLQRVRRHARCPAGDQLRGERRGRGRRRTYRAHRGGGRRAVRRRDVLRPAGRDDPRLRHRRRADLRGHADDGRNGAHRLGRAHRDHPGDRHGDHDAADLLGGRRYRPGLHHLRRDEGPHRQAPRSLGQPLCVVRDLRRQVHLPLTRPDGGWPHAAIRLEPVVAPQGSRRAASSPAHSYPAPHFPSCPRVADNRQPSAHSPRTKKSPLDGGPGKRTRRVSVSWHAPSCRDRSNSCRARSAAARGSDRRRRRCRNAAPPGRGRPAPAIARRGRDSSRRR

SEQ ID NO: 32136 - protein, 179 aa, Pseudomonas aeruginosa
ASFPGDRGMSRFQTLTPASLSREAFVEAFADIYEHSPWVAEKAYDLGIDDSLNDIEGLHQRMADILLSASREAQLALINAHPDLAGKAAIRGELTASSTSEQAGAGIHECSAEEFARFTELNDAYKARFGFPFIKAVKGSNRHQILAAFEERIQHSADEEFATALAEINKIALFRLQQL

SEQ ID NO: 32137 - protein, 257 aa, Pseudomonas aeruginosa
SWPATRTPSISSRYSTSRAPSPSGRTAVRPATSMASSATSPKAARVFAGPATNCCWNHSWRAWSCAATGGSSRRRVFRRFSRRCSRNTGCSTTNSASTMSTCRANTACRPATAITTCTTGWPSRKAWSTTSASTNTATPWSAATGSTSRSVSPAARCCSAPSRRATTRSRCFILSATAKMFVRLDRPSGTTASSARPTTRSIISLARRSSIRARPTSATTTPVATSRAAPAGLSAKAASEGTGAMRGWHRSAATTRG

SEQ ID NO: 32138 - protein, 174 aa, Pseudomonas aeruginosa
AGQGAPGKDRAAAGFSPAHLHRTQAQWREGKDRRARPSPCLSSSAGRREDLGRHRAGRQGQIRPGELRPGRQRAADRAASAVADGSAIRFRRSRHGAGRELRQRRLSGARYPRSDRRRHRRKQRRLEGKGQRARRRATGGRRAGVPLRARRAQRGEGVERRQGIGPADPCIFRS

SEQ ID NO: 32139 - protein, 542 aa, Pseudomonas aeruginosa
SLLRSPCLLWRADLMRLTFPVLSLVGILLSCSVGQAAEPQLSSMRCFASPAAPVTAYAPAKEAAMSADAYHAPKTSPRLETLDVLSVGMSLDVFRQGQVWKALQEQNAMQAEALHVGSILPMDPRKYPVTADDKDIASEKREADALELGLKNFLEKWPIPTVTVVRGWNPNTPNLRFTPEETQGSLSAMVNDMRIPAGLHWHRIVNLQDGIICNDTPEGVLEALFRLFERNPDLPAVLIYANEGFNMALSLMAKGEKPIGVGTGPRQPGELTDTMVALIVGRPERVDWLRQFAPYTKVNENRIDPEFRGWGWRKPPVEFRPTPFIPQPWTERALEQWDALPVLARLHRPVSVPLTRPDTGERLKREALTAQLAAAWKTASAGLRPAPARLFYDGGLNATPLAELTPALGAAQSSLDLLDSRESYDLTQRLGDTGAASPFVGIALATMASYLNGDSSMVMPLRRKDQATLIGISSPTPGKKPAHDPFGVDLLPQTASGDGPPPSADPVAPASRLTTRLPPGEDYALEEFLSSLKPSTDWQDDL

SEQ ID NO: 32140 - protein, 327 aa, Pseudomonas aeruginosa
FCMLGCRSYQDSHRSNRMRSWHGVVTKIAKQGKGAVVKNRLGPEELLVPFTVSTLVEVDLDARIYGTDVDDTPWAEGDERKEVLVGTEVELLTDTDTFPTHASQVLSANFRFALDIVKGGLSGPVRKGAVLVIYHDFQQEIRRGDSGSAFAEAVVAYARNKLYKPAFAIKADTNYAQLVRDLGKVAAESGEQYFIDTILIATHGTAGQLWLGNPHGESTADVMARRVQGKQFVEPQAFGATLLELFGKELAIALYGCDFAGDEDGEAAALELRIAANARAVYAGKGTVYLNASKEGRSTVTCSKAMVVYRTDKIEVLGGNQVPVFDI

SEQ ID NO: 32141 - protein, 598 aa, Pseudomonas aeruginosa
RSCRRHENNAAHATRRVSTPVTAVIASIMPAVSHASMFPPRRRSPILCRDCARKLARASNQPYILPRWRPSGQPANRPGSACLKNASAHKMHAHALIWSGEPMNRSALDFRHFVDHLRRQGDLVDVHTEVDANLEIGAITRRVYERRAPAPLFHNIRDSLPGARVLGAPAGLRADRARAHSRLALHFGLPEHSGPRDIVAMLRAAMRAEPIAPRRLERGPVQENVWLGEQVDLTRFPVPLLHEQDGGRYFGTYGFHVVQTPDGSWDSWSVGRLMLVDRNTLAGPTIPTQHIGIIREQWRRQGKPTPWAMALGAPPAALAAAGMPLPEGVSEAGYVGALVGEPVEVVRTQTNGLWVPANAEIVLEGEISLDETALEGPMGEYHGYSFPTGKPQPLFHVHALSFRDQPILPICVAGTPPEENHTIWGTMISAQLLDVVQNAGLPVDMVWCSYEAATCWAVLSIDVQRLAALGTDAAAFAARVAETVFGSHAGHLVPKLILVGNDIDVTEIDQVVWALATRAHPLHDHFAFPKIRDFPMVPYLDAEDKARGSGGRLVINCLYPEQFAGQMRAATASFRHAYPTALRRRVEERWSDYGFADA

SEQ ID NO: 32142 - protein, 326 aa, Pseudomonas aeruginosa
ERLRRGAYENRGTTVERQAEPAGVHHRSGRDGARRPAPDGGKEHRRAAGGEPWRGGRGGQRARLCAQDGPQGPFVHRYADQRDHERAGGQRGLEAERRHLHEPDDRSPPAPPAGRGRRPVARPAVHRRPGQGGDRRAGRADPATGTVHPRRLKRTCRPCPFPAGSRDNPRLFPLRAAAMSSPPKIRRYIPADRDATLAIWLEASRVGHGFLGEAELQKQKALVRDHYLDASETWLALDGDTPLGFIGLLDAFIGGLFVAPTAHGRGIGRQLVEHAATLKGALEVEVYAANREALGFYARCGFVESGRRPRDDEGRALEIVQLRREH

SEQ ID NO: 32143 - protein, 545 aa, Pseudomonas aeruginosa
PCAAAARRNRRQASERTPIIERFRPVGDGVRFTKVTVRYIFPASMTSLLWRLRHDAHGTGPERPQPESARHPRATDLRPADPGRNRRRMRGLRRDARLRRGLPPDQPGRPTARLDPPGPRPGRRHRHQPRRLDPHLGGAARRPGRGGTAGGRSAPVQRPPARSVPPPLLRLAGGAGSDLRIRQPRLPPGPGTFRRAFRGGRMSAPRSVLAGLIGAGIQASRTPALHEREGDAQGIRYLYRLIDLDPLGKSADDLEFLLAAASDLGFTGLNVTFPCKQAIIPLLDDLSAEARGIGAVNTVVLRDGRRIGHNTDCLGFAEGFRRGLADAPRQRVVQMGAGGAGAAVAHALLAEGVERLVLFDVDPARAPGPRGQPQPALRRATSARRQRPGRRPGRRPGIGQHHPGGHGQATRHAGAGGTVARRPVGRRGDLLSAGNRAAAPGPRPRLPHTGRRHHGGVPGGEGIRTVQRGDGRRRAHAGALRQPGRLSGAPLPPRGEGTGVRHGCSAIPPRQSSAGAAGEPRRRAGRCERSATRCSDWTPGRSRTN

SEQ ID NO: 32144 - protein, 683 aa, Pseudomonas aeruginosa
EEHLPEPRQFSQLDPAHTPPRLRHRRQAHRHVGRAVAGVAVAALEDLEEEALLERLGEHMEQLAALGVAVVEDVVVGQFAEELVVEVEARGEVVVIVQRDFQQCDPGLLGLGHGGEDVGAIEGDVVHAGTAIAGQRTGDGGVAVLGNVQRQAHAAAGATHGATGDQAIGVGQHHLVIGAEVEQALVEQHPAVQAFGGQRQGHVVDAPQAEAGGVGVVRHEVAVVDAAALGVPLDQIQQAAVEGAHRRDFPLVGAEQSAVRLASVRTSALQRLAGVTHAQRGGAQGRSVGLEETVGEGIGLGVQHQVDVALAQQADILRTVLTGPGEAQSLQPLAKARAERLVDGELKELDAVAEVRRRRREQLVHRHVRRLALQALAGLLLEVEQRAQAVDGVGAGRRGAEAVVEDLQRQRTAIAGRDDRREEACQVEAALTREAAEVPAPFQHVHCQQGRVGHLHEEDLFPRKIGDAAGIAVQREGVEAVEDQPEVRLVGPPHQVPGLLPGVHLAPPGQRLVADAQAADGGALGQLPEVIGQQRRFAEGIGSDVAAHQHQVGAEFLHQVELAFGALQVSPQAFPAAALEVAERLEQQDLQAQVGTQPAYVARAAVVMKQVVLEDFHPVETGGGDGLELFRQGAAQGYGGDRTLHASTPQCALRRLAPREGRRRNGGGADSPRGMRREATSGR

SEQ ID NO: 32145 - protein, 280 aa, Pseudomonas aeruginosa
RTRTKGHTHVAPEPRPRALRFPLPGRRPASPCRARPRRARFPRRRQGQPHRAQFPPAPQLRRRCQPGQGRGVDAELHPRRPLRLHPGQRRLRPRCPRSLQPEAGWRQGNGRHPTAADPRRRPPGRRLRTPGGGRQAARLEQRTEDRRMDAGAADPPLRRWPLAAADLPRRPAQRQRDRRPDPLRRPVPRQQPAQRRKHAGHVAVRPASRHFRPLRFRRRRISLQWRTQPARPVERRAEGHLPPTVPATATQPAARRLAAGRQPRRIPWPRRWQRARRQAR

SEQ ID NO: 32146 - protein, 317 aa, Pseudomonas aeruginosa
GVACRHGLHAGRQRVVPALPGLGVAPAAELGKAQGTLGAGQQVAGLLGLAWIDRVLPGCQLPAPGRRRSVATGQAAQGAIGEAQEQRDVVFVGQATDSVAGQRLHLPHFPAQVAEQVEVMDQVGQQHSRTGLATPGHLEITVGLLQLPERGDRQQPTERALGDQLARPHDQRIVPTMVTDQQRNARSPGDGHQLAHFVELHADRFFQQQRHPGGEAVEGGGDMQVVRIGDDRRLRPGFFQQPPMIAEPGHAGIRGERLALGIGHRTQARAGDSLQAVVMLAAHIAGADEGDAKRCVQGGPQSLFSCSLHDSRTSFQI

SEQ ID NO: 32147 - protein, 250 aa, Pseudomonas aeruginosa
SCCSACRNRRATWWCATAAASGYARCWPPSPRRRWRWHGVSTSPSSRRCRPRNVFAVIFSGTYSAGTLLLWLTYFMGLVIVYLLTSWLPTLMRDSGASLEQAAFIGALFQFGGVLSAVAVGWAMDRFNPHKVIGLFYLLAGVFAWCVGQSLGQVTLLATLVLLAGMCINGAQSAMPSLAARFYPTQGRATGVSWMLGIGRFGAILGAWIGATLLGLGWNFEQVLTALVLPAALATAAVLLKGLVSHADAG

SEQ ID NO: 32148 - protein, 350 aa, Pseudomonas aeruginosa
PKNRISNIPMPKRHQRTGKLGQAVWHRRERRSGLVQARFLALAQAHFLGDLPGQGVHRHRQVTAGAHVEAEVAVDAAIVFQRQETQLALGDVGLDPQAGLEGDAEPAPRQLSRQLQGAALQHRPARFAQTALERRQQVMDGQLALGHDQAMFDAIGEGDGLVSRQRVLRGDDGTEAEMADADLLQVGAARQGEGQAEVDRATAHRLGYRLGTEQGDADGDVRVAFAHRLEHAGQQVAGHRFDGGDLHMAGAQALQRVQFGTHALHVLQDHGDVAREDLPGSGQAQAAGQAVEQRRADLVLQLEDLPVHRRRGDVQAPRGFADRMAAANHVEVVDRGRVDMQLAAHGGPKG

SEQ ID NO: 32149 - protein, 400 aa, Pseudomonas aeruginosa
PPLALGVSADNACDAIRPTASAAGDLPGRLLRLHAKLVPHRFGEVEGRVGRGNTAVDGALHDHFLDLVAAHPVVLRRAQMQLEFLVAVHADQHGDGDQAAGVSRQPRTGPDVAPGVAGDHFLELFVERRQVGQAALDMGVAEHRAAHLHAGFVALFLVHRRGSSGGQQEIDQAAAEGVARFDVGQVRGGELDQLRVGDARLHEAGVVRSGHGIVAAGDDQRRRLDQPELLAEIGVAYRSAVGRVALRRGGREHRDDALDLRRFALGEARGEPARHRGVAQDTHGLLAAFQDGIDAGVPDLVAGNLRRGVAQHQPAEPLAGVDAQPLADQAAHGQPAEMHARQLEGIEQGKHVGAELADGVRSGGDQRGAVAAGVVAQHAEMGGECGDLRVPHAQVGAQRV

SEQ ID NO: 32150 - protein, 506 aa, Pseudomonas aeruginosa
QQQDRRAGRSFQGVVQVAVGEAYGWHEGDLQSGGMGFEAQGMVFGERALDPGAGLAEVMGGIEQAVQFVAGQLGAHPRLFAEHRAQLAALLDGAAAALFHQMVRGFAADTAGQGDAHRLGEHQAVGQAKVAAHPLGVHLQAFEQADRLLQRAGNQATEFRQGFPLGVPETEAALVFLRHRREQGRDQPRRTGGGGDQHRAAHRVALVRHGRGTAAPGAGRLEDLAGLGLHQQADIATELAEVTGHQAEHAGEFHQAVALGVPGLFGQSQAQLLGQRRGHRQGLFAERGERPRGAAELQHQQARAQLAQALAVPGQGTEQAGELHAQGHRGGVLQPGAPGQRRVGMPFGLVRQDLGKTLQILLEQGQRTAQLQHQAAVHGVLAGGAEMHVALGLGVASRHLAAQRLDQRDRRVAGSGDRLGQRQRVVQFGAAGRLDRRHRRRGNHPGARLGAGHGGLEVEHALQAAAVGEHRAHRRRHEIGIEQLVGGYVAHRFSFSRPVRARRSGS

SEQ ID NO: 32151 - protein, 663 aa, Pseudomonas aeruginosa
GSRRRRPRRCSATAPWGCRRGRRPVRSRSRRRRRRRSRTIPRGCRRRRRRWRRCACGVLRCCTGEQGQSCCCSLDRVRFILTVRRSVLFRCTRAAPPPKHGQRRATRALDTGRATRLCQSDPLDGQRQALADAYAHGRQAAPAAALLKLMERGEDQPRTAHPQRVAEGDGTAVRVDLLTVVGHAQFAQAGQALAGEGFVEFDHVEGVDRQVQAPQQLAHRRHRADAHDPWGDAGAGHAQHPRARSQAVLLHCLGGGQDQRGGAVVDPGRVAGGDGLLRPVDRLEPGQRLQGGVGTRMLVVLDQGVALAPANRHRDDFLGEETGLLRPAGALLAAQGEGILVGTRHAIVVGDVVGGLRHRVDAVLLLHQRIDEAPADGGVLDLLAAPEGAIGLAHHVRRARHRLDAAGDGQLHLAAGDGAERRADGVHPRGAEAVEGDAGHALRQTGQQQRHARHVTVVLAGLVGAAEEHLVQRRPVDPRVALDQGLQRHRREVVGAHRGKTAAETADRRAHGIADEYLAAHSSLPFCPWAAAVRASRSRSAASSTSLGAGVSETRSAKRIAQPVASTTCSRVTPGCSEVTTNSLLPASGSMMHRSVMIATGPLPGKPRRWRESPPSPWPTEVTKASLSTKVRCDCLRMISTSLALPAISGAPPAPGRRTLGWR

SEQ ID NO: 32152 - protein, 321 aa, Pseudomonas aeruginosa
AERPFPPGPSWHFPLNVTGTSNVRIHPRHHRLHHHPLRRRRRSRPAGPRPLHRAPDRRRRARHRPARQHRRRRLPERPGMGRGGRLHPEDRRPSRADHRQRLRPDHRQDRAPRAVRRIPRRRGGDGPADLLLEAQRGGSVPALPRGGRSYRRAGDALQQPGHQRHRHVGGTDPAHRPRSGQRNHGQGEHRRHPAHAQAAPARRRPGALLQRLQPAGAGGLRGRRERLVQRRAEPDPDAQRPAVPGGARRRPGEGPRAVLPAVAAARLHPPPGPADHHQGRPGPLRPGGGGAAPSGAGAGYRGLSVSAGVVGRAALITPSAL

SEQ ID NO: 32153 - protein, 460 aa, Pseudomonas aeruginosa
PDGPGRLGARRFFCRRAARSARRPGIETLFQLLAVVHPELGIHRPRAFEVGRRGRQRLLHRLRQQRQGALVYRPVGDLLGEHLLRLRLAGEGDEFLRQRLVRRALHHRPVLRIVETAGPDDGQFHPLLLRSGDAPVVGRAHHHVAGRQPLRRLGAGLPPLDVRLELVELGEGAADPLRGGKYLVEVLRLHPVGQQRHFQGVLGALAQATLAGELADVPEIRPGLRRPGQLRRVVGHHHRPDVGGHPALAESAGDELRGVAETRRVEAFEQPLVAAAEQFGALHLDHVPADLADVDHGLHLGHFAVVFAGDHLPAAASLEGFEIGLFLGGLGRAAEGDHRQALALRLGRRGERQAEQGQPGKHVCVLVQGLEHGTLPQPIGIVVMLLRQLPARGRNGSARGRQAPHRRYGGTLRVAVDPAEAGPPGRVRARRSRGRCDPPRYGSCRSVRRSRHARPPAPGP

SEQ ID NO: 32154 - protein, 102 aa, Pseudomonas aeruginosa
RASRKAPPPPGGWCGRTCCSTAVVPAGGWRRRRGPGGRSRGWCTRGRTCRPGSACRRCPRAAGHRRGPSPAGLRGSAPSGRGRRGCGARRPVAGSRGCRAAG

SEQ ID NO: 32155 - protein, 86 aa, Pseudomonas aeruginosa
RTWSWTPSWCRSTTASAIPTASTCRCSPMTSSSPCRWTRPTPGSPRSISAPCATRPSSRSPRASPPIRTAPGCSSRPASNRRSPCR

SEQ ID NO: 32156 - protein, 76 aa, Pseudomonas aeruginosa
  UNSURE (10): Identity of amino acid at the above locations are unknown.
PNAMATATPXTKDEPTPRNSDTTPETPARRSSSTFTPKAVATMAKSRSMAPPSRPIPDIRGTSTNPFCPPVATPPT

SEQ ID NO: 32157 - protein, 176 aa, Pseudomonas aeruginosa
  UNSURE (102),(127),(135): Identity of amino acid at the above locations are unknown.
SLLLSSVADRCCCFYASNERLSGSLFLLAQQRVQGIRPGAFEGRRGAAEQRPRQTAEDPSRRQLEMQAGTALVGAAQCRQPLDAARHVAGEIVGQRGRFGDXARPAAAHVWARAADAGGCRRRLRPXARPVRRAXHSATVRSPPGASPRWRRRARRVRRRRANPLRCRPPPVAARR

SEQ ID NO: 32158 - protein, 322 aa, Pseudomonas aeruginosa
AMTENLVHSSTSGISAEFGYYPATCDIESEQFSIQTLPNHRQTVSSIVEDVNVVDGWLYPRPQKRLDFVSRTVRSMPYSSRVFGLPKTHALTLHRSKNQDDLDFVVWCLSFFIGMRLTTTEVGFLDATPVKPHKLVDFVLHRCTLNEAVHLALNFLEQEHDAPRATKRVAAVIHALFLAQYPQSLPFERFQYLYMALDGCFKLLKVREEANVSVSHAGRIQWMCKKFNIPLPEWAESQAGPSPLSTARNDAIHEALFFDEPLGFSIYGGNKPDGNPTNVTLQMRALVCRLLVAILGRADTIYVKSPVNTRMIHSLELSDRVT

SEQ ID NO: 32159 - protein, 145 aa, Pseudomonas aeruginosa
LQSSEIFRSSAAASAGDAVLVEQFQQAVFVEHLHAQLVGLGQLRAGAGPGDHAVGLGRHRAGHLGAEPFQLVLGHVPAHRLQGAGQHPGLPGQRQAFDRLALALPMHAELTQLRLDGQGTLHVGRLVEEIAQAFRRSLGQTLHLA

SEQ ID NO: 32160 - protein, 666 aa, Pseudomonas aeruginosa
IEPVGADDAVERTEAAGQLFRAGGGDEGNVQLVDETGQRGTSGELRGDLALFLQLHAMFGIAQLGDHLAVVLVGEEVVDLVGHLGADVRQVGQHFRQRLADPLERTQRTRQQLGGFLADVGNPQGEDEARQRRLAAVGDGRQQVVGGQLGEPFQLEHLFIGQGIEIRRRGDQPAIHQLLDDLVAKTVDVHCPARYEMDDRLLQLRLTGEAADAAIDGALADRLLALAALDQLGPLHGRAADRAMLGHLDSLRIRRAALEHHLHDLRNHIASTADHHRIADAQAQAGDFIHVVQGRIGHRDAGHLHRLEACHRGHGAGAADLELDTQQLGQLLARGELVGDRPTRLARAEAQFALEGDAVDLEHHAVDLVGQRIASATDVVVVVAAGLGALDQAQLATDGDTPAAERLEDAHLGVRQRPADLAEAVGTELQRATGGDLRIQLAQAAGRRVARVGEGLAAGFHGLGVERLETGLGHEHLAAHFEDLRPAFAMQLQRYVANGAYVAGDVLAGAAIAAGGAAHQLAALVEQADGQAVQLRLATVLDLRATAEQVAARQQVGQSFAYAAVEVQQVLLLEGVAEAEHGDLMAHFAERRGRRAADPLGRRVGRQQLRVLGLQRLQLAEQAIVFGVGNARFVEHVVTVIVGVQFGSQLRDAFGGSLGVGHGGSP

SEQ ID NO: 32161 - protein, 306 aa, Pseudomonas aeruginosa
FAPSRTKKGAVAGSALLHQAATLMVDDALAVVLDGLGGQHAALLVLQLAVQLVGQLARGGNHHVEGLLRMARPRQAEEEAHGAGAEVVDVVQVESARFHRIGHGEQDLAIAGHAFVAMEDVHVAEAQAALEDVLQQCRPLEAALVAGDDVDDQHLVDRGRFGSNRRGFLPLFLLAALRLALARLHCLGGIARVRLQGQPLVEVQIALARLFLALAALAFLGFAGADAGQVLFVEGWLAMLDHARRPQQFSRVAVVVRQIGETAVELELQLALAAPHPPPTVQENAGDHDKPDNDKPFAQTDIHVIP

SEQ ID NO: 32162 - protein, 296 aa, Pseudomonas aeruginosa
PSSASCSCKALRRTTSPCHSRRCCSSWPRSSCDCCSAWPRRFSTSRSSRSASSRASRACLSSSSTAIRRSSNSSSFMRSSSSGAAPSSRLRLSCSQRSLRRADCWSRRSRACWVELCCAFSEPTRTANWCAWSLWVRASWRIRSSRSRRASRSASRVSRRSVSSAMLSSASCRVRRASLSCSCSSARCSASSATSSSRRRRRSTSCSTLACCADNCAFSSPCRRPSSWTWRRTCSRAPSSSRCSSRAAARRSSPSETRVSRGSRRSCNASSSWARAIMPPWASSLRRTRRKCRPTQ

SEQ ID NO: 32163 - protein, 335 aa, Pseudomonas aeruginosa
PSRLIRLSPSSRAPRWASACSRVSTGFTRANQGLRSASARTLSSSEPAAVAAPRAGLSRRSSPLPKPARASPSKPSSKTACRSAPSTVSTASSQPGSTRKPSARRGRCSRPCSRNHSKAPCPGSRAACCRASSEAMRPFRRCNSPCAWCCSAASCCNSWRNCSSRSAWPCSCNCSSSRASSAIATCSLSSRIAASSGSAANWPRSSCRRRSRSCRRSRLCSRCWMRDCCTSAWRRGSALCWLKASHCCCQACMPCSACSRAMPASSAAAALSSCSGASMAISSARVASKVRSCPRCDSVSWRVRSASRKSSCNWRWRCWPCWMLCSTRAMSPPTE

SEQ ID NO: 32164 - protein, 396 aa, Pseudomonas aeruginosa
VFCPSRETRRRMDISAYWAYSPTSVVSALSKISSMLAWLTGLRVFEPLKMTSVIDSPRRFFAELSPITQRTASMMFDLPQPFGPTTAAMLLGKFTVVGSTKDLNPASLMLFRRMRALPPGSPSAFGERGQHQLAVVAAVFQQDLADPRLVTGDHRLQELSKTAEELVHFRLAPFQRQVVGATHRRQQVFDGLLQVGIVRERKGRAHDVEAGLDEAVDIALRQVVQQALLDDQERCQLGFAAPAPGDAFRQQDVELHDQRVEAFHMLRGQFGHLGAAARQDVHQVAAFENQQRLADRAATDVEGLGDLLLLDTFPFLEFSPDDAFREVVGDLLCQAVRGLERHGDPFIQGRVFRGYMDGKCNTGRYPAGFPAKRRTERRLGWGRPVKGGQLSDNLTR

SEQ ID NO: 32165 - protein, 382 aa, Pseudomonas aeruginosa
IRGLPMFASLSSAWMLRLKKYGYWIWLIAVLGIPLSYWWSLGSDYPNAWPWLVISVVFGLIPILDAIVGRDPANPEEASEVPEMEAQGYYRVLSLATVPLLLGMLVWSGWILAHETRWDWVGQLGWILSVGTVMGAIGITVSHELIHKDPQLEQNAGGLLLAAVCYAGFKVEHVRGHHVHVSTPEDASSSRYGQSLYSFLPHAYKHNFLNAWRLEAERLKRKGLPALHWRNELIWWYAISALFLLGFSLAFGWLGAIFFLGQSVMAFTLLEIVNYVEHYGLHRRRLDNGRYERTTPEHSWNSNFLLTNLFLFHLQRHSDHHAYAKRRYQVLRHYDSSPQLPNGYAGMIVLALFPPLWRAVMDPKVRAYYAGEEYQLTDTQRI

SEQ ID NO: 32166 - protein, 208 aa, Pseudomonas aeruginosa
SSIARRRTPPKCRSWWPRSSGFPSTASSSTCAAWAAASAARKPRPRRRPACARWSPTTPGVRRRCACRAWRTCRSPASVTRSTSNTTSASTTMAACTASRSTWPAIAAIRRTSPARSSTAPCSTRTTPTSSATPPSTATVARPTPPRTPPTAVSAGPREWSPSRRSWTPWPAAWARIRWRCASSTTTARTSATSPITTRPSSTTCWRR

SEQ ID NO: 32167 - protein, 153 aa, Pseudomonas aeruginosa
RRGPARRDRRRRGLRVPRRADHPRLHRHPHPFPADRDDRLLRRATAGLAEHLYLPHRTPVRRQGPRRPGRRDLPAGTAAQRHHHRAGLRQRAPAIGGIAVRGRPAPGPAPDRRQGDDGPQRAGLPDRHRREQLPRQQGADRALARPGPSALTQ

SEQ ID NO: 32168 - protein, 453 aa, Pseudomonas aeruginosa
GVPAVESTKQEEQGIYAATPPATGLLERLFKLRQHGTTVRTELAAGLTTFITMAYIIFVNPNIMADAGIDHGAAFVATCLAAALGCFLMGLYANWPVGLAPGMGLNAFFTYTVVGTMGYSWQIALGAVFISGVMFMLLTFSRVREWLLNSIPRSLRFAMGAGVGLFLGLIGLKTAGIVVASPATLIKLGHLTSPGPLLAALCFLMIAVLEYRRVFGGILISILSVTLVGWALGLVQYGGVFSAPPSLAPTFLAMDIAGAFNVTMISVILAFLFVHMFDTAGTLMGVAQRAHLVKEDGRIENLSKAMKADSASSVFGGMLGVPPVTSYVESAAGVAAGGRTGLTAVVVGVLFVAAMFFAPLAGMIPAFATAGALIYVAMLMMGGMAHIDWDEHTETIPAIVTVIMMPLTFSVADGIALGFITYVAMKVLTGKHREVSASLYALFVIFVAKFIFL

SEQ ID NO: 32169 - protein, 349 aa, Pseudomonas aeruginosa
MAGIGKQDCIYRPQANLYTINPSRHPRPVRPAAPSTIRNTAVSADYPRDLIGYGNNPPHPHWPGDARIALSFVLNYEEGGERCVLHGDKESEAFLSEMVAAQPLQGVRHMSMESLYEYGSRAGVWRLLKLFKRRNVPLTVFAVAMAAQRNPEVILAMVADGHEICSHGYRWIDYQYMDEAQEREHMLEAIRILTELTGQRPVGWYTGRTGPNTRRLVMEEGGFLYDSDTYDDDLPYWDPASTAEKPHLVIPYTLDTNDMRFTQVQGFNNGEQFFQYLKDAFDVLYEEGATAPKMLSIGLHCRLIGRPARMAALERFIQYAQSHDKVWFARREDIARHWHREHPFQETEA

SEQ ID NO: 32170 - protein, 415 aa, Pseudomonas aeruginosa
RPVRRPLGNPRWRHLPPGEVQAGSAENAGEPALVQMGGLLHLDVRGGVADHRVLPEPDPLPDRPRQRPGAGGGHRHRYRFAGLRLVRLHHPLRFGAGQDPCPARPGPVRPAGRRRLRPDPGVQRPRRLPARRRDHRHHHGRQRVQGDHAGPARAGESHRRKPRARSGAAGQGPAALPAQQLLHPAGAVHHDQQPLPEHLRQPVQLADPGRHRGARGTGTPLLQHPPRKQPLRLGTARRRAGHDRPGLRHHAELPAGFRTAGQHPGGGTGTTGDRRRRTSRARRAPGLQCRDRERSRLRQGPSRDPGALHRLPLGETDQPAVQHRARRDHARHPAADPATGTEDPGPGRGLADHAAGQHHADDPGRTQPDRQLDRQGRTDQLSLGRKAKNRTSGSPQQNNPAGPTPKALSIEGFWP

SEQ ID NO: 32171 - protein, 190 aa, Pseudomonas aeruginosa
  UNSURE (128): Identity of amino acid at the above locations are unknown.
HRCPRHIAWALSTTRNVSMATPAYMSITGTKQGLITAGAFTEDSVGNTYQEGHEDQVMVQGFNHEVIIPRDPQSGQPTGQRVHKPVVITKVFDKASPLLLAALTSGERLTKVEIQWYRTSAAGTQEHXYTTVLEDAIIVDIKDYMHNCQDPGNAHFTHLEDVHFTYRKITWTHEVSGTSGSDDWRSPVAG

SEQ ID NO: 32172 - protein, 735 aa, Pseudomonas aeruginosa
VQYLLDTGRAELGGCRLGTHGDPADWPGGDRRLPGRRLRPADRHRAHLPGDQPTALRAARPQDPQHHQEQGVQGQSGQRAAHRRHHGADQCGADERPRCQRAAPGLPNPSSARRRQAARRGLRTAHRRTWRGACGQGAAAEHRGAAQGRRRPSRPRRRGAGAGGGAGAGPRAGRLRRGAPGRGARRGAAANPPGSRARPRPRCQRRVRQEQRRQAGDRLERSGRDRRGDAGEPDPGRRRARRQRGPAEPAGDRRAEGGDQRRQRHRPVRPGRRAAPDHPPGPDAAAGAEERHPPGSRAERGGQRQPAARAGHREGAHHPDVRRRLPDPQGRQHRAGHARQLRGQGGEAQSCRRGQPGSRAAAVRGGRDAAAVRPQATGRADGHAQRALYHHHGQRRGHRGRHRRRRRYPAAAEGCDEHRQGRYETHEIARLRSCRDSSGGWRGGCSRQAPEWPRRRGRTCSQRRGNQPGERRIRRFHRLFHGPPARRGLCPLAGQGLRDGAERPHLLRRGVARRGGLEPGEPAAPGSVHSRNDPCLAAPAWRQRPSGGGLPASQAVSPRRPVRLPVGAGKDVEGLQHRTAGRHRSRLFPREERVRGSLCEQQVRWRTEKLPNGILTNEMQDLAHCLPVRPGKRPGPGRFQTATADPGARRLRARDTGSTPLAGGNQRRRDHPCFGMSAGRQPLPGNAVADRAPARVACRGDRGLRRLSRLQRAPAPAGALAARWELQRIHSFQRA

SEQ ID NO: 32173 - protein, 763 aa, Pseudomonas aeruginosa
PSAPANGFQHCRRILPGRRTWQLDAARRSDLPGTTQRRGAARREAMNDRVRSRTIVSAQSITLPKGGDVHLVPPPPKPCVTIVVHGVNDLAGCYERIERGLCQGLNERLDMPPTLPGGQANPGYLTPAGYSLPADDEGKAENPDVVYYRRKFASGAGGAAVRSVVVPFYWGFREEEQYINKTAAHGEWLDRNGNRLDKSGTKEGGQFVNATTNLPDMWGQGFNGKLFGFISLDWFGGTMTHPLFSAAGRKYMVLAAMRLAMLIKIIRKRYPDDTINVVGHSQGTLLTLLAHAFLKDDGVEPADGVIMLNSPYGLFEPLNEKLQGWSSQQTREARLATLKGILEFICGRRHPVPALSSVALRNCQGYGAIGGPGWVGGQGCQTTIDGERLSFDERDNRGSVYLYFTPQDQTVGLANVQGIGWRGIAEQVKGLPGRTGLPQGFHQRIFTVRKRNGEKEKIGGHAPPHVYPLLLAGEKTWEDTGLGGKDRFGRANFDQGDSVLLTAPRLPLPTEARFDFDGAVTAPGENSASGVYQVRDTLDPIDAAIGVSNGGWKEKDSGHAVAQQVDAALAYRYGRDARSVERALNEGKELAQQTHVFSARELGTGMVLVTRAETPYEARLRLQTAEGHLEPLSFHSAIPNNPEHNRRVLAYDLAIGAGDSVDDVVFYQYLCRVADWRLDWNATRAKGRAQVESDTELDLPDEDVRALYRAEEAGNRKLIDSTEIYRRSGAIPSIVGNTLPSLVATQTINDRYYDRPVCFGGPI

SEQ ID NO: 32174 - protein, 162 aa, Pseudomonas aeruginosa
VVPSVPEHVWAADITYLPASSGPLYLCLVTDAYSRKIVGHHVHESLHAKSVAQAFRQALRKRQRRQSLVHHSDRGIQYCSALYQSLHARHGVQCSMTDGYDCYQNALAERINGILKTELLLSSPENLEQARKMVAEAVQIYNTERPHMALKNKTPDAVHRAF

SEQ ID NO: 32175 - protein, 117 aa, Pseudomonas aeruginosa
ARLPRRAANSTSSIRSSSPPTARLANSGWATPTARAPRTSWPGVSRASSSSSPRPLVRPFSNCSARNWPSPSTGATSPGTRTEKRRPSSCASPPTRERSTPARARCISMPAKRVVPR

SEQ ID NO: 32176 - protein, 251 aa, Pseudomonas aeruginosa
DRESALGRTFSSCGWFLRMLPDSMVGSSARRLRLRRTRGRVGLGLVAGLSVLAGMTDAIGFLATGDFVSFMSGNTTRLAVSLGEGDFGGLVRLSVALASFVVGNALGVILARFSGRRAAPILVCCAMLLALSAVWPFDWNVPALVAAILAMGMLNAVVEQVNGLPIGLTYVTGALSRFGRGLGRWLLGERRNGWRVQLVPWSGMCVGAVLGALLEQQLGLAAMAASAALAALLALLALVIPRPWQMDYMVR

SEQ ID NO: 32177 - protein, 216 aa, Pseudomonas aeruginosa
STACTRNSSPGKCVPLRRRSATPIRRRCAGESKNAGATTDSPTPERYNPRPGERGSRKVTGPMTETNALGLPQGPLYLMTEIVRQRERQLTALLAPLELGLHEWRALRIIHAFDGDVPMSVLIEHSQTDRTALGRTIERLVRRGWVSRLPDPDDGRAVLVRRSPAAQAVFEQALAQVAGLDERLLAALGAGPEEEALTLALGKLLRAFDGLSRVTQ

SEQ ID NO: 32178 - protein, 322 aa, Pseudomonas aeruginosa
GPAPPAVARRPAVPRTPGPRPRTQRGIRFPALRAQPAASLPSPTDPAGRRCRPVRRFRPVRPSGRPALGRAADRAGIPGESEQAPGRHRRSAERRRTSAQPRPASPLLRHRPTSGRVRADTALGRRATGARGPSPGPTFVGEAGDDVFQSVRCRFPRLPIRSPSTILAGRENGSGGARMKTVAQLLNAKQNQQVYTIGADEMVLDALRLMAEKNIGALLVVNHGEVVGVVSERDYARKMVLKGRSSIGTPISAIMSAPVVSVDSKQSVDTCMNLMTDRHLRHLPVVEDGQLLGLLSIGDLVKAAIAEQAELIQQLEQYIRGD

SEQ ID NO: 32179 - protein, 183 aa, Pseudomonas aeruginosa
GGAPRCSGVPGRCPGDARTRRFPGARGNAARPVAKRPIGIPDHDPAVPPPAGPSPAAPATPPARRSATATTARAPAQRRRTRRLWRRTACRYSAGPRPPGTTPAPPAPGAARRGAPASAPATVRRASARSRRCARRTGSHGCTTAVRTGWKAARRESARPRPGAAPSPCARRATERDRRAGAA

SEQ ID NO: 32180 - protein, 519 aa, Pseudomonas aeruginosa
CPLPSRSVRPRCRLVRSRPEPARRPYRPRRPDAVDLPQRPRPDHRRRLPAGDLGRLRRPRPAGLGDLGLHGGDDRIDADLRQARRPLRPPPSDALRHRRVHRRLAALRARAEHGPTGAGASAAGDRRGRADGGEPGDHRRHRPAARARPLPGLLQQHVRHRQRRRPGARGPAHRVPVVALGILDQPADRPSRAGHLAANPGRPAGAAPATGDRLPGHRADGGGPHRAAPGHHPDRPGRSLERPCAARPVRPGGARPAAVRRPGAALPRTAGADATVRRPRRHPQLAGCVLRQLPGHLADRAGTAALPERYRRRRRQRRAASAAAGHGPAAGRVLLRAADRQPGTLQAADPARRRPVALRHRRPGPGPGRRPLAVRAVHAAHRDRHRYPVPDQPGGRAERRGATPHRRRHQQCDVVPLPRRGGRGGADVGDPAGPAQAPADRRRARPGLFRERPAEQPGRRQRAGPGDPPACPRGCLQGALPGQRGGGAARPGGGLGTARHDPARPRRDATDGRRVSGRR

SEQ ID NO: 32181 - protein, 156 aa, Pseudomonas aeruginosa
HHCCGGCAMTRTVLVLNGPNLNLLGTREPQTYGRRTLGEIADECAAFAETRGFAVDFRQTNQEGQLLDWIHQARGRVAGIVINPAAWTHTSVALRDALAAVELPVVEVHLSNVHQREAFRHHSYVSPVALGVICGFGSLGYRLALEHFAERFEAAA

SEQ ID NO: 32182 - protein, 189 aa, Pseudomonas aeruginosa
TPWCCAMAGASATTPTAWASPRAFGAAWPTRRASAWCRWARAAPARQWPMRCSPRASSGWSCSTSTRRGPQALADNLNQHFGAPRALAGSDLAGALGDAQGLVNTTPVGMAKLPGMPVPAELLRADLWVAEVIYFPLETELLRQARALGCRTLDGGTMAVFQAVKAFELFSGVTADAARMQAHFASLGD

SEQ ID NO: 32183 - protein, 952 aa, Pseudomonas aeruginosa
QFQESGTRSCPSPTSPSALHPVRWPLVRPDRPWPADTGAAPGPPACNPERQIQAGRPGTGRRKDGPVNDPLFQLSTARRRRPAGIPRRQDPQRLRRRPDALGHARPGVLRHHPELHRSRRPRRDAADPCREDELDGNGLRQHQLLVPGRLRHRLHPPGPLHRQGRGQARVLPRRAALEPGHRRPRPGDLGGGLHGLSLHPRPDRGGQLPGLREDHPPVVPRRGTGGGHRHLQRRHQCRRDGHPGPVAADPQRLGLAGGVPLHVGAGPGLAGVLVAQLLQPRGASAGEAERAGIHPAAGGAARHPRALLADSPPPRHLGLRPGLLDHRAGVLVLPLLAAAVPQPAVRPGHQRDADGHPADPDLVDRRLRQRRRRHPFVLADRPRHAGDPRAPAVDAAVRLHHRRRGVRRQRQRPVDRRAGHRPGGRRAPGVDGEHLEPGDGLHAQAPDEHGVRLRRHVRGAGRDVHDPDRRRRTDRDEQQLRGALHHDPGDVLHRPDLAVLHGSAPDRSLSPSARRSPGTSLPREQERRDTPMSHPSHVRALCASLCLGAGLPVHAGHVHAGQGFLEDAKASLTARNFHLHRNFVGDASQGKAEEWTQSFILDARSGFTQGSVGFGLDVLGLYSLKLDGGKGTAGTQLLPIHDDGRPADDFGRLAVAGKLRVSNSELKIGEWMPVLPILRSDDGRSLPQTFRGGQLSANEIAGLTLYAGQFRGNSPRNDASMQDMSLFGRPAATSDRFDFAGGEYRFNGERSLLGLWNAELKDIYRQQYLQLQHSQPLGDWLLGANLGGFRGRDAGSARAGKLDNRTVSALFSARYGLHTLYLGLQKVSGNDGWMRVNGTSGGTLANDSYNASYDNPGERSWQLRYDFDFVGLGLPGLTFMTRYLHGDHVRLAGVTDDGSEWGRESELGYTLQSGAFKRLNVRWRNSSQRRDWGSNTRFDENRLIVSYPLSLL

SEQ ID NO: 32184 - protein, 156 aa, Pseudomonas aeruginosa
ARREPVRPRGGAPVRPSPPCPAPSIRSATHSRARGRASGNAAARSWSAARWDRSPAPPLRPGAPPAPAPPCGSGWPARRARMQCRTAAPRAPCRGRSVARRWRPGTWRSRSGDRLRLPPGAPVRRSPGRARRAPAGPDRPPRWTRGSGSPARPGGC

SEQ ID NO: 32185 - protein, 273 aa, Pseudomonas aeruginosa
ATRPTLVPRPHSRRGTRPMNSPSLPAVERLDVQAFINAQPLSPYQWRIVLLCFLIVFLDGLDTAAMGFIAPALTQDWGIDRASLGPVMSAALIGMVFGALGSGPLADRYGRKLVLVAAVFLFGLFSLASAYSTNVRATAGAALPHRPRPRCGDAQRHHPAFRIHPRAPQVATGNQHVLWLQPGHGLRRIRLGEADPAVRLAQPDAARRPGTAGPGGSPAVPPAGIGALPGGAQPRQRAGTPGAGPHRPGAGGAGTEFPRPRAADGAGPATCSR

SEQ ID NO: 32186 - protein, 330 aa, Pseudomonas aeruginosa
WAGSSRRSSSSPDNSALTRASSPSTARNSRRCSTARRQHCSTRWCAASRPIRRARAMLTASASTRPWVRPRLRRIRWASTSRPSSRPIACCSAPATRQQSSGRVSHSACQRPRLRSCSCGIAANRVETSPGARVAAAISTALLTGLRLCGMVEEPPRPAPAGSKTSPASVCISRLTSRPNLPRLPATRPSTLANSTRRSRWVCQGCSGRARPSSSASAAATGRACSPSAASVPEAPPNCSTSRRGRNSRRRWRCRVKAPSRPASFMPRVTGVACCNQVRPASGVSACRSAWSARTSARRCRSCSSKASARRSCSTRPLSMASWLVAPRCT

SEQ ID NO: 32187 - protein, 164 aa, Pseudomonas aeruginosa
NIPVEDVLHPYRLQPQGDVLGRAAEDRVAHRVGHSDAEGAHLRREHLGLDQAADGGVQADDGQRQDDQEEGHVGTAHGLQREQDRQGAQRAQGAEPEHRGLAPDAIGKHAEQRLHQHVRQQGEGHHRAGGLGAHPGGVDQVLLHVGGESVEDQRAAGGEAEHGE

SEQ ID NO: 32188 - protein, 251 aa, Pseudomonas aeruginosa
GPLVLEQLGEGAGFLALQGRLRSGLVQRAPQPEGDHRGDRADHEGNPPAPGAQFVFAQQLLQDHHHQHRQQLSADQGDVLERGEEAALALERHLAHVGRTGAVLAAHRQALEHPRQQQQGRRQGADAGVGGHAGDRQGAGAHHHHRDQHGGLAPVLVGDAAEHPAADGAHEEAGGEDPGGVQQLHRGVVGGEEGRCEVDRAEGVDVEVEPFHEVAGGGADDGEDALAAFFVAVLVNRGSHAVVLSTGSVSS

SEQ ID NO: 32189 - protein, 197 aa, Pseudomonas aeruginosa
WSAVRTSRAPLIPSGWPRAMAPPFGLTFSLSSATPSSRRQARPWLAKASLSSITSKASIARSRRRSSLRTAGTGPMPMIRGATPALAMPSTRARGVRPCFSTASAEARTSAAAPSLTPDALPAVTVFSGPLTGLSRASASRVVSGRGCSSCSTRVSPLRPRIVTGTISSAKKPASCALPARCWLRRAKASWSARDTR

SEQ ID NO: 32190 - protein, 231 aa, Pseudomonas aeruginosa
SSATLSAVCGIGSMPYCSFISGLTKRQPMVVSSIFWPRPKALSALPITYGARDIDSTPPAMASSISPQAMARNAVPMASIPEAQRRLRVTPGTLSGKPASSSAMRATLRLSSPAWLAQPRNTSSNADQSTPGLRSTRAFSGTAARSSARTAERLPPKRPIGVRTASQMNTSRLIRRSPSVHGRPRCAPRGRAARRVRPRSARASRRPARRSGSPSRWPRPPARGSRPDAAK

SEQ ID NO: 32191 - protein, 426 aa, Pseudomonas aeruginosa
CCRSGRPGPRRGSRRRSVRPAASSGRSRRWGPRYRRSRPTRRRRWTAAGRWAWRRSARTRRSARRPARKSGAPGWRPSTAGRCRRSTPRRCAGGGRRPRSSSRWCCSCSSLALRELGLEGPEILGPPDVFVDPRGEAFAVAGDRIPVLVEAVVALVVAVGIGRMRAAGHQAHGAERPARQDAGVHRGVQFVDDLLDGDDAALRRQGRFLLHAEDAPEQHVALAVGLLRVDHADVRTHRGHRRQHFAGERAGDAADQRVDLRQVGAGVGAQHCEGQPGGAGDIGVGEVGVAVFLDLQRLRPALLHRVAQAVQRTDAGVAAPGEHQLLRAACTDQQVVDQVGSHADQRQVFPALADQLVAGGRRDQVSEAFEGDAVAIVDEASHRFAQGEDFSHRSGLVLLCAAWTARDENLTPGSEGSQSDNRLTVR

SEQ ID NO: 32192 - protein, 543 aa, Pseudomonas aeruginosa
PAKAGPDLPDSLRGRPRLRARRADHLARPGGGDLLHPATGPGLRRDQRRQPAAGRRRPQRPPRARHGESGQSLPQLGLSRPPGRQLHHPHPPAAHRRAVDPGSTAAGLAHGPLPAIRRLRLPQGLAGRAGRQRGRRDHLRRPRRQARHPALPPRPAGHRCEHRGGLRDRGAARARGEDAVAGDGRRGDQADPAGPGARGPRLDLHPEAPRRRIQLLRPALPAAQQRLPELNDLSHQVRPGISHSMSRVHPMSASIHGIIGYTITPFAADGGLDLPALGRSIERLIDGGVHAIAPLGSTGEGAYLSDPEWDEVVDFTLKTVAHRVPTIVSVSDLTTAKTVRRAQFAESLGAEAVMVLPISYWKLNEAEVFQHYRAVGEAIGVPVMLYNNPGTSGIDMSVELILRIVREVDNVTMVKESTGDIQRMHKLRLLGEGRVPFYNGCNPLALEAFVAGAKGWCSAAPNLIPTLNGQLYQAVLDGDLEKARALFYRQLPLLDFILRRGLPTTIKAGLGLSGLEVGAPRLPVQALDTEGCRYLQGLLEELR

SEQ ID NO: 32193 - protein, 596 aa, Pseudomonas aeruginosa
GSCRPEAETVPRAVARRRIVVMGGRSVSQSTRPRPGRRGASEHADLAGGAIHRDTGLVDQFVDLGTPGHQRRGHDHAAEGGADDHALLEADGAAAPGQIVLVGEALAGHLVLGELQRGDEAGALDLADQRMVAEDLAQAALQVGSGLLPDPRDHALVAQRLEVGDGHRRRHRVAGIGQAVGEHPALIHQHLGDALAEYQAAHGDVAGRQALGDGQGVRLEAEVFVGEPFAGAAEAADQFVGAQQHVVLPADALDLRPIALRREDHAAGALEGLGDEGGDVLRAQFEDLLLQLQRRAATELGRAQLAAVGVPVGFVDVGEVRQHAAHLVHELHPAERGAAQGRAVVAVPAADHDLLLRLAEDLPVAPHGTDQHLVGLGAGVGVDRVAVVVRQQAEEHLGKLHHRRVGGVEEHVVVRQLFQLAAGGGGEVLAAVAEVGAPEAGHAVQVALAVVVPELQAIAADHHPRAFAVQRLLVEEGVDVVRGVQLLVVAGVALRVELSGHRLCSPCSLGASGRRGLQGIEGDGLALGSLTGRLERFGYEKGLAHHALDPHHRHQRDHAEHHAGAGENPSGHFRGRRDVDHRVYHPGDAEQLRQRV

SEQ ID NO: 32194 - protein, 892 aa, Pseudomonas aeruginosa
RRAERTGDVRIATAQGQHVYVGDDVCQQPGQRGGEQQQVDRIRVLAEDHDLHAGDRSHEQHRHPGRARPPAELLELREGLAVLRHPVEHPRDRRQRRVEGAAGGGDRGDHQEQLAVLAEHAVGEEEVWQRVAGQFRLRDAQQRTEAVEGDGQEDDAQAEDHRTRDVALRTPRLLHQRADELGADEAPHGHRGERQGAYPERVPAARQGGLRGSVVAAHRTQAEHQQDDHHQQRQRALQAREDVDAEQVEQGEQAEHAVGHQHRRQRAGVDLADDQVEQQQFRREGEHRHHHVAGKGRQDRREMPDGHLGVAAQATGAGNHQGQLGKGKGVAQRQQVGHSQRHDEAQAGRPGALQHQYHHALGNHQADGHRQQRSQPEHAAQGRLTHVRRVVHSIVLLLSLSASSRVASVASSAQLEPGRLQLGVLVEGMQRQVATEAGLLAAAERHRDVQRVHGIHRHRSGIQAPRHPVCTVQVVAPQRGGEAVAAVVGQAYGLVLGVEGADRQHRTEDFLAGQLHVRAYVAEQGRFDEVVRTVDRQLAATAEQGRALALRPLDGGENPGDLPAVDDGAGAAGRVQRIARLPVAGLGQQALDELVVDRTLHQQARVRRTDLALVEENAEGGLFRRQVKIAAIGEHQVRTLAAALQPDLLEVGLRGILHEVLADLGGAGEHQCVHLRVQAEGLAGLLAEARHHVQHAFRHPRLQGQLGQAQGGERRLLGRLEHHRVAGGQGRGELPGGHVEREVPRHHRADHPQRHAGNGGQGLLGGRRDLVVELVEAFRIPGEDVGGAGYIDVPGVHHRLAHVQRVEQRQLFAMGQHQLGQAQQHALALDRGETRPGAFVEGAAGGGHCRVNVGRIAGRDPRQQAIARRIDGVEGSAGWRLDAGGRRSGPGR

SEQ ID NO: 32195 - protein, 151 aa, Pseudomonas aeruginosa
IIIESQMKKFLLPALLFAAASLTGCASYNVSQPIAPVAGAVKTDLKADVAVGEPISGDSSVNILFGFLKFGGDSQFADGVTYGAESGSGLSLGAFDPVSSAKAAAAFKAVKNSNADLIVAPRYEVSVNDYFLFKKVDVKVTGSKGTIRSIR

SEQ ID NO: 32196 - protein, 106 aa, Pseudomonas aeruginosa; identical to SEQ ID NO: 25116

SEQ ID NO: 32197 - protein, 91 aa, Pseudomonas aeruginosa
CVISQYVHDQSASNHHAGMQKNQHLRKAFGQRIRDLRSSQGFSQEAFADKCGFVRTYMSRIETGTANPSLEAAKVLADGLNMSLSELLQGL

SEQ ID NO: 32198 - protein, 222 aa, Pseudomonas aeruginosa
SVHPKRYRVINMFIRAYLRASTDKHATRAKQLLIDFASEHGQKIAAFYVENESGTKLDRPELFRLLEDSHEGDCILIEQVDRLSHLSPDDWASLKAIIAAKRVVVVSLDLATSHAALKPAATMDDFTKGMIAAVNGMLLDMLAVVARKDYEDRRRRQSQGIAKAKEMGAYKGRQADEDLHARIKHALSSGMSLRKAATTVGCALSTVQRVAKMQLKPASPDF

SEQ ID NO: 32199 - protein, 249 aa, Pseudomonas aeruginosa
APNSTTNASTPSNRCFLALSIVNSSLRKSFAAAPPLQRATPCSSNSFSRPSSSSTFTPSSLALASFEPAPGPATTQWVLADTEPATLAPSPSSLSLATSRLIASRVPVSTQVCPARGRPSTALRSLCQCMPNSRNCASMARARCTLAGSSKKSRRLFAARSGRRSTWRRSSQSARMMPSSEPKRLASFSAPVAAMKGMFSLSMKPASEAQAANSAATSPSSCNCTPCSASRNWAITWRLCSSAKKLWIS

SEQ ID NO: 32200 - protein, 153 aa, Pseudomonas aeruginosa
MAPSLIDSLPLLRLTNWVRSTAEPQTGQCSGTSIACASAGRRSSTTCMTCGITSPARRITTVSPMRRPRRATSSMLCRVALDTVTPATCTGLRRATGVTAPVRPTWNSTPSSSVSSSRAGNLWAIAQRGSRARKPSSRWKAMRLTLNTTPSIS

SEQ ID NO: 32201 - protein, 272 aa, Pseudomonas aeruginosa
CSMVWAVNTLRCSSFSSPFSSWASLRAAATITSKACFGWRGPGRPRKKLTARVLKLSMSSRSKVPGFTALAMENRISPLPAMLSWRWKMSMSPKRRPLSRMFCNNAGPLKPLSSRAMTLMISTSSTGAGSAATAGAFSRSFSLRPFDLPLRGSTVSAASLGSASRASPSSRSRSPWRGSSWRLPPLRSLASRALTLGRSCSSKDGSRCSTTRAGPSSSAESPSSSGRLAKLRSSLNFNLPLPPRIRRQPSKRMPAITISPITISHSRRPISM

SEQ ID NO: 32202 - protein, 201 aa, Pseudomonas aeruginosa
GAPTAGRGAPGPAGWNCAAPSASRPAPPTGAHGPCGCGHPGESGRAVRAGRHAPPAGFPGARCPAPCYPALPAGSGAPRSVAPVPARAARPVPPLLRRDGGDAVPVARPWPAARTTAPSARRAGAPPPGPGAAPARARLPARAARRGPQPDAPRLRRHGFPGAPAAPATPPVPGRGRSCRPGPRRCAGPAGSAGRPSSHRD

SEQ ID NO: 32203 - protein, 492 aa, Pseudomonas aeruginosa
QEPAWRHALIRFLLNREIRVEERLDPNLTVLDYLRRHLGKTGTKEGCASGDCGACTVVVGELVTGEDGAERIRYRSLNSCLTFVSALHGKQLITVEDLKHQDRLHDVQQAMVDCHGSQCGFCTPGFVMSLFALQKDSAGADPAKAHEALAGNLCRCTGYRPILDAAEQACCHRRADQFDAREAATIEQLRDIAPRETAELNSGDRRCLLPLTVADLADLYGANPQARLLAGGTDLALEATQFHRELPVMIYVGHIREMKRIEVGANCLEIGAATPLTDCYQALAADYPDFGELLQRFASLQIRNQGTLGGNIGNASPIGDAPPLLIALGAKIVLRRGERRRELPLEEYFLDYKVTAREEGEFIEKILVPRARPSQAFKAYKVSKRIDDDISAVCAAISLDLEDGRIVRARVAFGGMAAIPKRAAACEAALQGARLEAASFERAAAALANDFTPLSDFRASKEYRLLTAQNLLRKCFLELHAPAVETRVTAYV

SEQ ID NO: 32204 - protein, 651 aa, Pseudomonas aeruginosa
PSQAAQEPGRAGRPVPRRVDHRGRPQRQARKRPQARQRRGDLHRRSPGVSQPVARLCAPERARPRPHHPPRRDALLPVPRRRHRPHRRRRSRPARHRPGGGRRPAAGRWQGGVCRTDGPGGRRRQPGNRAQGGHGGDRRVRRPGAGARRGRGPAQAPFRPRQPPAPHRRFRRRAGRRAASPARHAAHRRPGAFLPGDADFLGNAQRRRRHDRLLLDAEPHRSAEAGGRGPRGFLQPHRHRHAPHGRRLRRQGNPGRGAGLPVRGGRLPHRASGEDAPAAHGGHADHRQASPVLRRIRRRLRRRWPPARHPDRPGRQLRLFAGPLRLDRRPRHVPLGQRLLPRQRHHQRPPLQDQHRLEHRLPRFRRAPGNGRHRGDHGRRGPQPGQGSAGGAQAQLLRQERAQRHPLPPDRRAQPVGGDDRRAGSEQRVRPPPRGNPCLQCRQPGPEERPGADPGEVRHFVHRDLPQPGRCADPHLYRRQHPPEPWRHRDGPGPQYQGRPGGRRGLPGRRGAHPDHRHQYRQGTQYLAHRRLLGHRPERQGRAECRRNHQAAPGGVRRAALEGQRGRRRVPQQPGAYPRADPAVRGTGPAGLLRPGFVVQHRLLPHAEDLLRPRAGPWPALLLFCLRRRLLGGDSRYPHRRIPHAAHRHPA

SEQ ID NO: 32205 - protein, 433 aa, Pseudomonas aeruginosa
RRRLAEPGHRHRPGRRRLRPGHGLADHGGTGLERQGQADDQRPGQLQDSRRRRHAAGPAGETSGEPQESGADRVPFQGRGRAAVHARHLGLVRDQGRRGQPRRLPRATRHRRAGDARAGALGRGTDAPVEDRPGASGGRRGRAGLNRRDREDDEMNWISALAELQRSGEPCVLVTIIEERGSTPRNAGSKMVVSAERLYDTIGGGHLEYRAQAIAREMLAARTQDTRLERFSLGASLGQCCGGATVLLFEPMGQPQAHIAVFGAGHVGRALVPLLASLPCRVRWIDSREHEFPALLPDGVEKVVNDEVLDEVERMPPGSHFIVMTHNHPLDLELTAAILARNDFAYFGLIGSKTKRVKFEHRLRERGVDAERLQRMRCPMGLDQVKGKLPAEIAISIAGEVIATYNAAFGLERKQGPSSVTRLTPESRRAHES

SEQ ID NO: 32206 - protein, 660 aa, Pseudomonas aeruginosa
AAPRSPASAARRRTSHEPFFFETAMTRNAKAYRAAILHSIADPAEVGVERSYEYFEDGLLLVEDGKVARLGDAEALLGEIGDVEVFEYRDALITPGFIDTHIHFPQTGMIASYGEQLLDWLNTYTFPTERQFGDKAHADQVAEIFLQELLRNGTTTALVFGSVHRQSVESLFEAARRLDLRLIAGKVMMDRNAPDYLTDTAESSYRDSKALIERWHGQGRLLLRSDPALRPDQHRGTAGHGGAAAARASRRIPAHPPVGEPQGNRVGEGAVPRAQRLPGRLRPPRPARAALGVRPWRAPVRRRMPAPGGDWLASGVLPDIQPVPRQRSVRRAEAGALQGQGRPGHGCRRRHQLLPVAVPERGVQGHAVAGRPPRSVQVALPRHPRRRPRAGAGRPDRQLRHRQRGGLRGPRLPRHPAALLPPEPGRQPGRTAVRADHPRRRPHGEGNLRRRSLGASPRLTPGGNEKAPHRGAFQCFGSGRRIAVGLGPAWLLLAAEEVREHRVQVAGSVVALQVELAVDVLHVVHHQGHRALLVALLDGVEDLVVLVERAVRATAAFVLGDDQRGLRHQAALETHQRSVARHLGELQVELAGQADAGAPVATGEAGLFLHHHLAQLGQALGGGVVGGQFGDGALDGAAGEKDLPGLVDARAGDHRAPVRP

SEQ ID NO: 32207 - protein, 473 aa, Pseudomonas aeruginosa
PGYRRQPQRYRGPAPAHGRHSPVGKPRGPAGADQRPPGPRRQGGDPWRTDRLQHLRAGRRRDSRMQRRGVRPLHRTQRRLQGQVRLPLHQGGEGQQPPSDPGGLRGTHPALRRRGVRYRAGRDQQDRPVPPAAALRPAETSMNAEHSPFRHYLDLADARLGSQVVAVSDEWFAPASRMLQAGEPVWKEGVFDDSGKWMDGWETRRKRFEGHDQAVIRLGVPGVLKGVDIDTRFFTGNHPPAASLDGCFCTEGDPDDSTSWSEVLPAVGLQGDSHHYHPIDDERPWTHLRLNIYPDGGIARLRLYGVPYRDWSSQPPGTALDLAAAVNGGRALACSDQHFGRMGNLLNPGRAINMGDGWETGRRRTPGHDWVIVALGHPGSIEAAVVDTLHFKGNYPESCSIQAAFVEGGNEARIEAQSLFWRELLPAQKLEMHQEHRFERHLNALGPITHVRLNIFPDGGVSRLRLFGRPQLP

SEQ ID NO: 32208 - protein, 187 aa, Pseudomonas aeruginosa
DPGPACVRNTTNRIDRISMRTLKIEPLTKEAFAPFGDVIETAGSDYFMINNGSTRRYHKLATVETAQPEDNAIISIFSAEKLEMPLRIRMLERHPLGSQAFIPLLGNPFLVVVAPLGDVPVPGLVRAFLTNGRQGVNYHRGVWHHPVLTIEKRDDFLVVDRSGSGNNCDEHFFTEDEQLLLDPQSNQ

SEQ ID NO: 32209 - protein, 441 aa, Pseudomonas aeruginosa
ERSCRRSAGQGKRYKTVEAHLIEWLNLLVRWIHMIVGIAWIGASFYFVWLENNLNRSNPREGLSGDLWAIHGGGIYHLEKYKLAPPKMPENLHWFKWEAYSTWMSGVVLLTIVFYLNPTLYLIAPGSDLAPAAAIAIGIGSLVCGWFVYTILCDSALGKTPALLGLVLFVLLVAAAYGLTQVFSGRGAYLHVGAIIGTIMVGNVFRVIMPAQRALVKAIEENREPDPVLPAKGLLRSRHNNYFTLPVLFIMISNHFPSTYGSQYNWLILAAIAVLAVLVRHYFNTRHESNRFAWALPAGALGMIALAFVTTPNYQQASAPLASTPAAAPAQPATGGDAPAAPAAPQASNAGTASGADFDKVHHVIQERCTVCHSAKPTSQLFSTAPGGIMLDTPQQIQQLAPKIQAQAVASQIMPLGNITQMTQEERNLIGSWIAKGAQIN

SEQ ID NO: 32210 - protein, 1043 aa, Pseudomonas aeruginosa
ARVTWGSLLQRMGEEPPARNKERSMRQRDLKFTFVVGEGKLAFDVVEFELEEALCEPFRLNLKLASDKNAIDFKQVLDQPGTFTLWQDGRPARYVHGIVSHFTQGSSGFRRTRYELLLEPQLARLELCCNWRIFQEKSVPEILQALLKEHRVLDYEQRIYHEHLPREYCVQAGDSDHYLHDRLAFEEGLVYYFRFDEHRHTLVCSDRLYVQERIAGGPVLFSAQPEGDNPQPVLHSFRYSENVRTARQTQRDYSFKRPTYDQEHHLAGEALEHQGSSYERYDYPGRYKQSGAGRPFSESRLRGHRRDARVASVSGDDPRLIPGHAFAMEGHPRADFNAWWRPVRVVHRGTQYAGQEEESADAPLGVSYDLRAELVPEDVEWRPAPLPRPRIDGPQIATVVGPAGEEIHCDEWGRVKVQFPWDREGRHDEFSTCWIRVAQNWAGADWGHMAIPRIGQEVIVDYLDGDCDQPIVTGRTYRATNRPPYALPDHKILSTIKSKEYKGSRANELRIDDTTAQISAALMSDHGASALHLGYLTHPRPEGGKPRGEGFELRTDEHGAVRAAKGLLLSTEEQLRAGAGHLDRGVVVQVLEAALELARELGDYAGEHQGVGHDAAPQQTLQEAVRDLGHGANDESGKSNGGKPAIALSGPAGIAAATPASLTLAAGEHVDSVARQNQQVTAGQKVVINAGSDIGLFAQGGELRQITHQGPMLLQAQKNDIRLEAEQSVEVSASQQHVLVTAKEHITLMCGGAYLTLKGGNIELGMPGNFVVKAAKHSHVGAASLEAELPQFEVGETQRRFVLKQLDGQTAMPNVPYTITMANGEVIEGVTDAEGATQLLQKDAMNIAKVDMKHTKSPASAVAGIAAAVGAAVAVGKLLSGPDAEAGRALSEGEISLAKGVFGDSIDYSTVRLRDEDYVPWQGKDYVMAPNGHIYFGEELRGVADWSLESLQRQGLFIHEMTHVWQHQHGVNVLLVGAYQQARQFLLGDQYAYRLEPGKTLKDYNIEQQGDIVRDYFLEKNEFGEASANSRFAGVLKNFPTGY

SEQ ID NO: 32211 - protein, 166 aa, Pseudomonas aeruginosa
PMKCKTLLIACLFGLGSAQALAVSKLPPQIPVHAGSGRVTLDLRPLLAETNDVEITRVSVCRRVGSHCQETLWRIELPPGWRAGEIEVFGDYPGSSVLLRRPERLQPDGSYNAFIHFNERSRRHQQTVSSIAVEFCLAGEPGNWMLLDEATCLARRNAEERQGEKP

SEQ ID NO: 32212 - protein, 424 aa, Pseudomonas aeruginosa
FLGAGRFTSIVLHARMPFLPGLPQEQQDALMAWRSHENRQARQGRRGQESTRPGRASGALHSEYARRGRPGRKDLRNGCGRHALGGGRRTKGGAGRYRSRTADRYGYLSYPCVPGAQRQFPFRPRHRQGRAQRPGQERGGPGHLPRLPAGDPERRLRQRLRGGGRRLCAEQALQAGLRDQGRYQLRPVGSGSRQGCRGERRTVLHRYDPHRHPRHGWPTLAGQPPRREHRGRHGPACPGQAVRRAPGLWCDPSRTVRQGTGHRPLRVRLRRGRGRRSGGPRAAHRRQRESGLRRQGHGVSQCQQRGSFHGDLQQGDGGLPDRQDRGTGWKPGTGIRYLRPRPALSLPIDQDLRPQTLRLAPGLFPGESLKIGSPHWGGPSLPAGGFSGCFQTAWWVAARGAFVCGGRAGVSGSAWWPGCRYWQA

SEQ ID NO: 32213 - protein, 128 aa, Pseudomonas aeruginosa
RNSLSRASPGLRSNSHPGHGLTIRPPICWPIDSMGGLRKPIRPAMPRHPHTTLLLCLCLILPGCESGRSYSLSEGAPVTGIRIQRDDRSPLQRLRDCERQGCSERQKIDPFTPDPDYLRAEGHFPLPW

SEQ ID NO: 32214 - protein, 302 aa, Pseudomonas aeruginosa
ASLFARSRRAFFRSRQIPSAALSAFLRTKKESLSPLSERADFSAVAVRIPLVTQRQRGSAMTGLPSHGNGRASGACPCPALPAPLRGLKMNDYIARLREKYDDHFGCAPSIVLDCRDFWRHCVAAPEMAVFGYRLESSRRPHHVVITAGMSQARMHFAPYMGSARWSSELICYLDVLGGEDLRHLQWLAGLPFHERLALGHGHSVAFGFPLYEHSLLRHFLLLPTPLGEDAALFDGFDLSAHPVDLLWVVPLTEQEYQVKVNKHLEGIAEVLNDAGHPLSLDRHRHCYVTGQRPEGFERILH

SEQ ID NO: 32215 - protein, 426 aa, Pseudomonas aeruginosa
HSTANKNTATSRQDQRRRMRRRPAITARGLSAMKTQVAIIGAGPSGLLLGQLLHKAGIDNVILERQTPDYVLGRIRAGVLEQGMVDLLREAGVDRRMARDGLVHEGVEIAFAGQRRRIDLKRLSGGKTVMVYGQTEVTRDLMEAREACGATTVYQAAEVRLHDLQGERPYVTFERDGERLRLDCDYIAGCDGFHGISRQSIPAERLKVFERVYPFGWLGLLADTPPVSHELIYANHPRGFALCSQRSATRSRYYVQVPLSEKVEDWSDERFWTELKARLPSEVAEKLVTGPSLEKSIAPLRSFVVEPMQHGRLFLAGDAAHIVPPTGAKGLNLAASDVSTLYRLLLKAYREGRGELLERYSAICLRRIWKAERFSWWMTSVLHRFPDTDAFSQRIQQTELEYYLGSEAGLATIAENYVGLPYEEIE

SEQ ID NO: 32216 - protein, 559 aa, Pseudomonas aeruginosa
AAPPRRNAGAPFPRREATLAQANIDERRPTDRFSAAPVLPQAQYDARCLRVPSAPGAVLSDLAQNPPAVRTVLAGLMLSIFLSALDQTIVAVSLPAISADFADLDLLAWVISAYMVAMTVSMPIYGKLGDLYGRRRLMLFAIVVFTAASLLCGLAQSMGQLVLARVLQGIGAGGLMAVSQAIIGDIVPPRERGRYQGYFSSMYAIASVAGPVLGGLLTEYLSWRWVFWINLPIGLLALAISRRTLVGLPVPRRQPVIDYLGIVLMVVGLTALLLAITQIGQGAAWSDPALLGLFALAALALLLFVAQERRFREPLVPMQLFAVRAATLSWLVAFFASFQAISLTVLVPLRYQSVTGAGADSAALHLLPLVMGLPLGAYCCGRLTASLGRYKPLILLGAVLLPCGIAGLALVPVGDHWLSGLCMLLTGIAIGTQFPTSLVAAQNAVEQRHIGVATSNATLFRSLGGAVGVALMSAILLALLKHLRIGGGLDQGFSESALLSSLDAASGPARVILQHVLADAFKVLFLVNAAVALLGLAVASALPDMTLRGRGATQPTAGE

SEQ ID NO: 32217 - protein, 110 aa, Pseudomonas aeruginosa
ICSAPASHRPTAGGPWAKSPTNARPSPRRAASPWTSARPTRKANCSTGSTRPAAGSPASSSTPPPGPTPRWRCATPWPRWNCRWSKCTCPTSTSAKRSATTPTSRRWRWE

SEQ ID NO: 32218 - protein, 265 aa, Pseudomonas aeruginosa
RPPATADRDSRTRRPARGSLPGRSRPDPGSSGSAGSIPARPLPARARRPSARRRSFPPEDRRCRGDRRPARGCGSCRGSARGSPGRPAAPGPRPAPRCSPGAPRPAPRSRCAGRGRRRARPAARGHRPAAPVRRGHRQRRCCTPAPGRCRVPASGRTCVRRAPGFAPGVPGGSPRSRGTAGTAGSPGPGRHTAGVRRAGCRRNEAGRSRRFPPRRNRRRRWPRAFPAGCRSGIRWRSNAACFDSSMRPTAPGAARGPAAERRRRG

SEQ ID NO: 32219 - protein, 545 aa, Pseudomonas aeruginosa
RFFDQSRTIAATRAGRPDLPEALRASFRAPAQPTRHNNFKNRVPAHVHRRPLRPPSIPSAGRSSGPTAPGPLTPARPLARPRATQNDKSRPGAQAPAAERMAPSMIHSSSSRLLAADAPRESRGGRIRNAFAVGRTRWGMLALVFFATTLNYIDRAALGVMQPILAEKMSWTAMDYANINFWFQVGYAIGFILQGRFIDKVGVKRAFFLAVLLWSLATGAHGLATSAAGFMVCRFILGLTEAANYPACVKTTRLWFPAGERAVATGIFNAGTNVGAMVTPALLPLILSVWGWQAAFLCMSALGLVWLVFWWRNYYNPEEHPRVKQSELEYIQQQEEPPATRVPFSQILRRRGTWAFALAYSITAPVFWFYLYWLPPFLNQQYGLGISVTQMGIPLILIWLTADFGSVGGGILSSWLIGRGMPAIRARLLSMLLFACTIVGVVFAANASGLWIAVLAIALAVGAHQAWTANIWSLVMDYTPKHLMSTVFGFGGMCAALGGMFMTQIVGGVLTATNNNYAVLFTMIPAMYFIALTWLYFMAPRRIEA

SEQ ID NO: 32220 - protein, 114 aa, Pseudomonas aeruginosa
VQAPGARRAPPCLENKNEGTHPCRTRATSARSALPSAWAPACQSMPGTSTPGKVSSKTPRPASPRAISTCTATSSAMPARARPRSGRRASSSTPAPASPRAASASASMSSVSTA

SEQ ID NO: 32221 - protein, 185 aa, Pseudomonas aeruginosa
ACCEAYAPTPLRSAATAPGDHQAAGADDEDAEQRPGIRHVAEHQQAEQAGEDDLAIAERRQGRRRRMAEGLGQQQVAAHAATAQGDHHQAVEKTWSLPEERHQQAHDERVEDAGEEVAGGRAVAVGEHPREQLVEPEAQRRAEREQRRRGEQRATGTHDEEHADEAGEHRQPLAEADLLLQQRHG

SEQ ID NO: 32222 - protein, 252 aa, Pseudomonas aeruginosa
RGHQQRCQEVHRGRLGQGQVAQAGGEEQAGADQAQRPRQLHERTAAADHREAVARHEHGDHQQGVHQVAGPDHHDDRVETGKELGQPVVAGEQEHRGTDQQDAAQGLVAGGQRGGGCVHRRVRAPGQIDSRLFILTVPAIEERNDRLQRLETIEPRSIMQTGNLPARWRYRRASSARVRSIASRARSAPSTPRASRSSAGTSRLSGRFSGKARSSASRSSPPSPGKRRSSRAWRRISSIDVGRGPTTSQSCA

SEQ ID NO: 32223 - protein, 255 aa, Pseudomonas aeruginosa
RAPNSAPTSSTAANSPTRVSGRRRRISTSSVRTPAVAQPRQGPPAQAGIGQQRIVVLFHGGRHQAQADMTVAGAGGSLDHVRGRQLEHGERRQGKNPRFHALPHRQRFRNWPARRPGHCARPREPPRPAPGCERRRWHPSMALPRPARPGRSALAGVVGGRLSPRPPRWPPAGRASPAGPRRSASGGAGEGSGHPRCRPAGSRVARPGVDRPGSPRLPAPSSRAPPQRRNRSGCPGRHWRSAGAARCCLRWAGHG

SEQ ID NO: 32224 - protein, 133 aa, Pseudomonas aeruginosa
PGGGALGLGDPGLAIAFDYPQAHQFAGLPGEPVEHRLDQIDHPAGREEAEAQRGQAGAEAVAAGVVVLAHVAEPDQLGEHAVRGALGDIQAVRQLLQGQAAGIAGEEFEQAEGAFDEATGHGRTFLSRGKAGF

SEQ ID NO: 32225 - protein, 218 aa, Pseudomonas aeruginosa
SAWSSAPSVPDRWPTATDASWYWSRRSSSSACSAWPRPTAPTFEQLLALRFLTGLGLGAAMPNATTLLSEYTPERLKSLLVTSMFCGFNLGMACGGFVSAKLIPLFGWHSLMLLGGLVPLVLAVVLLFRLPESARYLVVRNRGSERVRQVLAPIAPAQVALARSFHVPEQQTVQAPQRVRGDLFRYLQRRHPAALADLLHGPGDRLPAHQLAADPDAR

SEQ ID NO: 32226 - protein, 195 aa, Pseudomonas aeruginosa
RREPGAGGVHRRAVPVRRGAQRRSGGLGDGSLQPAQGDRPVLPAGGGVRLVRRPEPRPGHPAGDPGAAGRHVHQRRAVGDAVAGSALLSDPGAGHGGLLDARYRPLRRHPRRLDRRHPAGPGLELRTGADRPGAAGCTGHRRGAAEGVGQSRGCGVKLPHRVGRITACGYPPSGFGVSADNAGGVIRPTPGGGIA

SEQ ID NO: 32227 - protein, 494 aa, Pseudomonas aeruginosa
  UNSURE (139): Identity of amino acid at the above locations are unknown.
PLAVIRRRASVYRRITPVALSAPPHGWRHRIRRRRFASEGEFHIQRRRRGAAAGATVDAELVVPILVADAEPQVRLALVAWQGGDHQGGADQGFRRGVLVVVVLALLSHVVDEALELRRMVADLERPHPGQVEHVGGVXGVVGMARAGHAEVVLLAVVEQAQVEHAGTVELEGRAEHQGALLGRSQVVVAAGVEAQGEGVVLDQAGAQRPVEHPRSVELVAVDRIDFAATMVGALARVAVVGKEHIEIEEIAAVAIAVGVGEAVDALGELVRVVRVGELLAVTETDAVAHPFQRHALPGADERDQGGGALHHLLHAVCPAGCLLFLWRLSPRFRAGVAGQYRHFAALTKEQNIEHTDAETASADGQARASRLASARAPLRPRSGALPRARAGALPRRSAGPGRPPPPAGNGRCARRGRGRCGCRHCLSAAGNAARPGRCRPRSPGGSGRRRRARAAPVVATAPGSCSPAPPGAVRANGAGAAPAGDGWTARSWP

SEQ ID NO: 32228 - protein, 250 aa, Pseudomonas aeruginosa
VRGSACPTCPGRCPASLTTAGPARRPVLPGSSSGRRRRGVRLARRGSPVRRDGVRSPGHGVRRARARPRRGPGRGNGRDRAGGPVRRRTTRRSPAPLRRAPRATRGAARRRGGSTVPPDGARLRGRYGGPGRCSPPRRAPGRGSGQGCGASAGRPPPGLRAGRSPVAARRQPGNRVPAGFPTRRARDRGCARVPAASPRTGSRPAPAHGWRRRSAPRCSPGCACAAWSRNRRARRRPARRPRRPRSASAG

SEQ ID NO: 32229 - protein, 171 aa, Pseudomonas aeruginosa
HRDRTCRGYRPPGRARWRIPPGGRAGCARVVRAEPGPAPRPAPRPPAGPVRRARRASPRRRRIAAPAGAGATRAGAGGAGSRHRAGRRASCPGSPGWRAATRCARPAACRHAVRPGPPGPRQDVADPARARPAHGAVAAPGRCPWRPGWWRRDARSARPRRRQPPPGGPAP

SEQ ID NO: 32230 - protein, 111 aa, Pseudomonas aeruginosa
KISEPPAVKPSTVNKARLCLNSSAKVPDSLRSRVDFEAVSFSERRSQRAITAVIAPITKGIRQPQARSSSSLSNCCRITTTSTASNCPPIRVTYWNEAKKPRWPLSATSLM

SEQ ID NO: 32231 - protein, 295 aa, Pseudomonas aeruginosa
HFVSYNLIRVIYSRVVAWRATAWRFPRLAPSKEPRMATTLELPKDQLIQHALKQMKSSLGDNTWTDRQKLALTCRILFEAGHDSGLAGQITSRGPEAGTYYTQQLGLGFDEISAGNLLLVDEDLNVLHGHGMANPANRFHSWVYRARPDVNCIIHTHPLHIAALSTLEVPLQVSHMDLCPLYDDCAFLKDWPGVPVGNEEGEIISAALGDKRAILLSHHGLLATGASIEEACVIAVLLERAAKMQLLAMAAGEIKPIPPALAREAHDWISTPKRHGAAFNYYARRCLPRNSDCLS

SEQ ID NO: 32232 - protein, 287 aa, Pseudomonas aeruginosa
RLSLARRMASSSESKALIASTGPKISSRASCMSGRTSPNRVGSMKLSEPLIVNWRPPPSRVAPSPCARSMAARIPAICRRSTMAPARLAGSSGSPGCQSRALASRRSTNSSWIERSTSKREFAEQTSPWLKKMPKAAFSAARSRSRQSANTRFGLLPPHSSQTCLRLDCAEYCMKYLPTSVEPVNTSASTSGCKPRALPACSPRPGTTFSTPSGTPASRASSARRRAENGDCSAGLSTTELPAARAGASFQAAMSSGKFHGTTAPITPSGTRVMVARVCWAVGATWS

SEQ ID NO: 32233 - protein, 249 aa, Pseudomonas aeruginosa
SLSRLSAYQAKTWAAPGTSMFQASITGLPMFSESSSASSSRWASISSARRSSTRLRSTGARRAQGPSSKARRAAATAASTSAASQAATRASRRLLAGSMASKVAPAGGWTLAAADQGLVDEALCRGAPLPIAEFEHPTFSLLSRRSAPVVVLHAWPGPPGGGPLSMGSMGKDGRASRGEGKLLKMSSGHKKKLARRAPAKCVVLGYRAGGQSSSRPAPRRSAAACNLLAARRTQQSRRARPARGRMMRR

SEQ ID NO: 32234 - protein, 309 aa, Pseudomonas aeruginosa
GLAVASYTLRQLKYFVTTVECGSVAEASRKLYIAQPSISTAVKGLEESFGVQLFIRHHAQGVSLTPAGARFYRKAQELLRMAHEFEQNALADNDVIAGQIDIGCFETVAPLYLPGLIAGFRQAYPGVEIRIRDGEQQELVQGLTSGRFDLAFLYEHDLDSTIETEPLMPPQRPHALLPEGHRFAGQAQVSLRDLCLEPMILLDVQPSRTYFVSLFEELGLTPNIAFSSPSIEMVRGMVGQGFGFSLLVTRPHSECTYDGKKVVMVDLAEPVSTSGLAAAWLKRAQLTKPARLFVDYCREQLGKLAERRH

SEQ ID NO: 32235 - protein, 332 aa, Pseudomonas aeruginosa
RPFLPLPRRLRHNPPTPPARGTRMLIDEEITLKKLETFLAFMRTGNLARAAAELGTSNVSVHRAIHSLESALRCPLFKHEGRNLTPLESAYVLEERAQKLVQEVLDTVRLTREAAGFSAERFKLGALYSLTVKTVPQLIMGLKLRRSALNIDLILGSNVDLFYQLKNMELDAILVSLNDSVSDPDCEHLPLFSDDIFLAVPVDSPYARLAEIDLSTLRDTPFVTLTQGFATHQDGTRVFQQAGFEPQIAMQVNDIFTLLSMVSSGVGHALLPKRIEAVYENRVRLIPLQPRYRLQQHIGVVFLKAKERDPNLLALLAECRMYSLRLEQEAAG

SEQ ID NO: 32236 - protein, 349 aa, Pseudomonas aeruginosa
  UNSURE (162): Identity of amino acid at the above locations are unknown.
RTEIHITAGPLTYPQPSPFRERVPGRARSPNQAAHAEIQQRRPQQATDGGIERRGQATVGHQLRVGGGEAAGDAAGGAHETTEDHRRTWIVQADVGRDERRQDHHQDRLHQPGGDDQRHHLGAGPQGGAGHRSDDVGDRAGADGGQADRIGIAERHGHRDPXDEGRTDSEEQRHHPGNPCPTQFLDIHPEGRGDDGEVAQHGATQQADSGHQGHVHQSFLPAGGDAADVGQHQAEEDRDRRAVQAPAGEARRQPVGHRHGHADDGEAADQAVAIDDFVQGLEHGAHPCTLVRGFNGRAPSAFFRPKRSSSGTRAKATATAAMPARIAAGPPLSAPRTFCWAAMATTMGI

SEQ ID NO: 32237 - protein, 120 aa, Pseudomonas aeruginosa
  UNSURE (7),(15),(40): Identity of amino acid at the above locations are unknown.
AYRRTVXCSTNRPRXWPKPSPASACIGRACPYMSSSRARXVAEPAALADDLAGNMARRVEWLATLRSAYERGARLHLELPPGRVLSGLARPLFGCATPAFEGSRADTLDALLREEEKRTR

SEQ ID NO: 32238 - protein, 156 aa, Pseudomonas aeruginosa
TWCRASASRPARPSACTRRWTHWCSPAPPRSASTSCSIPRNPTSSRSGWSAAARVRTWCSPIAAILTWRRKRPPSAFSSTRARSVRRTRACWWSVRSTTSSSSACWPRPATGSRAIRWTRPAAPAPSSTAGRSPGFSPPSSGRKARARPCSAVAAS

SEQ ID NO: 32239 - protein, 425 aa, Pseudomonas aeruginosa
STRPVSRWIAPPARSACSDAPRRPGLGRVDCDTERPPITTMRRLATARGTVSASGRQLPQQHHNNANRLWECSMFKSLHQYAHVFSRLSLFGLAFAAAAQAQSQSLTVISFGGATKAAQEQAYFKPFERSGGGQVVAGEYNGEMAKVKAMVDVGKVSWDVVEVESPELLRGCDEGLFERLDPARFGDPAQFVPGTFSECGVATYVWSMVMAYDSTKLARAPQSWADFWNVREFPGKRGLRKGAKYTLEVALLADGVKAEDLYKVLATPEGVSRAFAKLDQLKPNIQWWEAGAQPPQWLAAGDVVMSAAYNGRIAAAQKEGVKLAIVWPGSLYDPEYWAVVKGTPNKALAEKFIAFASQPQTQKVFSEQIPYGPVHKGTLALLPKTVQEALPTAPANLEGARAVDAEFWVDHGEELEQRFNAWAAR

SEQ ID NO: 32240 - protein, 735 aa, Pseudomonas aeruginosa
TPASCRAGRSAPCAWCPAARIRPMPTATTSATTASTRTGIRSPATAKASPRGSTNTSGGPRISGPSRPSSRRASDEQLQHQRDDDRGRRPPPAQRRGVLRRHRPAVEGRQPGAPDFLAGRRADLRVRADRRQAQRPAAVHRRRRVGRDRRYRGPHRRDLPLLAAGRTDRRRLPRRGPGRPLRQHQHHRDRRLPPAQGAPAGSRRRAGNRRQRQGSADHPQAVAPHLRRQAGLRHLGRPWRGWRLAPAPGLAGQGAGGDHHRPVHHGAGSRQQRVRGHFAASGRDPRAGGRGHRLGDPLRRAGLRDARAERGRTRRAARPRGAHRGRPWTEGERRMSREVFICDAVRTPIGRFGGSLSAVRADDLAAVPLKALVERNPGVDWSALDEVFLGCANQAGEDNRNVARMALLLAGLPESVPGVTLNRLCASGMDAIGTAFRAIACGEMELAIAGGVESMSRAPYVMGKADSAFGRGQKIEDTTIGWRFVNPLMKEQYGIDPMPQTADNVADDYRVSRADQDAFALRSQQRAGRAQEAGFFAEEIVPVTIRGRKGDTLVEHDEHPRPDTTLEALARLKPVNGPEKTVTAGNASGVNDGAAALVLASAEAVEKHGLTPRARVLGMASAGVAPRIMGIGPVPAVRKLLRRLDLAIDAFDVIELNEAFASQGLACLRELGVADDSEKVNPNGGAIALGHPLGMSGARLVLTALHQLEKSGGRRGLATMCVGVGQGLALAIERV

SEQ ID NO: 32241 - protein, 471 aa, Pseudomonas aeruginosa
TTSPDGPGKGKPMSDIPANQLFDAYFMAAPMRAVFSDRGRLQGMLDFEAAMARAEARTGVVPATAVAPIEAACRAELYDPLALAEAVATAGNSAIPLVKALGRQVAAGDAEAERYVHLGATSQDAMDSGLVLQLRRALALLEQDLQRLAEVLADQAERHADTPLAGRTWLQHATPVTLGMKLAGLLGALTRHRQRLRELRPRLLVLQFGGASGTLAALGEQALPVAAALAEELGLALPEQPWHTQRDRLVEFASVLGLVAGNLGKFGRDVSLLMQTEAGEVFEPAGAGRGGSSTMPHKRNPVSSAVLIAAATRAPGLVSTLFAAMPQEHERSLGLWHAEWETLPELCCLVAGALQQAIGLLEGLEVDAQRMRRNLGLTHGLVLAEAVSIALARRIGREAAHHLVEQCCRRAVEQRRELRAVLGEEARVSAELSGDELDRLLDPAHYLGQARAWVERALAEHHALGFEPHPA

SEQ ID NO: 32242 - protein, 268 aa, Pseudomonas aeruginosa
LEIPFVPTVRLADGDLNYSLEGPAGAPVLLLSNSLGTDLGMWDTQIPALTAHFRVLRYDTRGHGASLVTPGPYAIGQLGADVLALLDALELPRVHFCGLSMGGLIGQWLGIHAGERLGRLVLCNTAAKIASDEVWNTRIDTVLKGGEQAMRVLRDASVARWFTAGFAEREPAQVERIVAMLAATSPQGYAANCAAVRDADFREQLGLVQAPTLIVAGSHDAVTTPDNARFMQARIADAQLVEFAAAHLSNVEAGDAFSRRLVDFLLSA

SEQ ID NO: 32243 - protein, 137 aa, Pseudomonas aeruginosa
GAPPMDEKQRYEAGMQVRRAVLGDAHVERSLANLTPFNEEFQEMITRHAWGDIWTRPGLPRHTRSLVTIAMLIGMNRNEELKLHLRAAKNNGVSRDEIKEVIMQSAIYCGIPAANATFHLAESVWDELGVESQQASR

SEQ ID NO: 32244 - protein, 371 aa, Pseudomonas aeruginosa
VAGGASGRANGVAGVIRRYPEGQRRLSVLRVGRRGGASPCHSPAFPGRSTAPSSLRSAMSRKLHIHAPAIHYFDMVRRCHSIREAARRLNVASSAVNRQILKLEDEIGAPLFDRLPGGLRLTGAGEIFARHVTVVLQDMERVRSELDALQGLRTGHVEIATIEAVTSDLLPCVLKAMRERYSDITVGVTLLGSQAIPEAVSSGAVDLGLAFALPRSADLQQVSVGHFRLGAIVSPQHPLARHQAIAFADCVEHGLIMAKSELSIHHLLAPLQRRLREPRRAVLESSSLELSRQLARRGLGVAFQTRLGIEADIAQGELRFLPLKDNGGIHSDLGLYVRTGRYLPVAVDALARQIAEEVRLREREEARLNEA

SEQ ID NO: 32245 - protein, 324 aa, Pseudomonas aeruginosa
  UNSURE (191): Identity of amino acid at the above locations are unknown.
VATRTTSNQQDTQHEEDDAGRRRPDRARRRRGEHGAGMDEQQRRFPLRPAIHQPEQPGQVRQAHLQLHPRRRLSLRQQFLQSRCVPFRQPRPAQGHRPWWQRSLCGLPPPALRFAGVRPAAGHRPGQGLRLHPGLRRQPQQQPGFGQEARPGVRPDPQVQRSRRARPEPALLPREEPLRRARRAPSRPHLXHHLHAQPDLDAAVQGRQPCGEVPGLRQLRGREGRGLQRQGHRGGNPGPHRPDGRRPARRQAPAEPVARRRLRVLAQQVRRRRWHRQPHLDADVEYGIHLLKRSAVALCDAANRGVGRITPPALSADTPKPDGG

SEQ ID NO: 32246 - protein, 315 aa, Pseudomonas aeruginosa
RHRRYPPIHRSPTADNRKRLFALRDGAASPRIRVTDQPLQQHRGGGQCSRQHQGGQHLFEVPAQAQQGGADPGAEDGAEAADTEHPGDPRGPPLGRIEARCQRRHRRLRAVDAHAGQQHQGRQQGDLAEALADAPGEHPRQQVEQADHLVRVEAIHRPAHRYGAEHPAELEQRADERRLLQARAAIAHQGRQPAGEQVDDHQAHEVGQPEQQGAGAVGTGKDHREHVAGPAPSAARGRGNSVPAPPAPGRWGPAPGVPARCRGCAPPGSAPIPAGGTAGLPPGPAVPGRRAASGCASRTAGSASPRRIRRRPCPG

SEQ ID NO: 32247 - protein, 296 aa, Pseudomonas aeruginosa
PHRTRPRLARTPRQRCPRPAPATTGGPPGYPQERRAPHARRADPARLREPGPRHQPLPPQHPPGRAGLPLPRVQRGGRSGPAGARRARPGDRRTGAPGGNRRRSPDLDRQVPGRHLRATLRPRHGARGAAVLHCIRARLAGQPEPQGGAGAGGAPGRRGGAGLRSQRAALQERAAALPEARPRARLCVADRMLGAGHGGDGRTGAPPRGRTGSRRAQRGRAERTLRRGAHARTGAPAPGRGAGPVPRQPGVRAVPLSHPARPQSFPDISVRIANAFLPVTSPHAAGLSALPWMRRR

SEQ ID NO: 32248 - protein, 371 aa, Pseudomonas aeruginosa
SPSLNLERRSGIMKRTRKQRLGTALDAPLRIALIGAGNMGRQHYHRLQRIAGARLCAVADPQGQAFAADAGVPWFGDHRRLLEEARPQAAIVANPNNLHVATALDCLAAGVPLLLEKPVGVQLDEVSELVAVARRSGVPLLVGHHRRHNPLVVRARQLIAEGALGRLLSVTALWQLKKPDSYFEVAWRREPGAGMLLTNLIHDLDLLRHLCGEVREVQALAGNAIRGLPNEDNIALLLRFANGALGSLTGCDAAAAPWSWELAAGENPVYPRQAEQPCYLLAGTEGALSLPQLRRWRYAEARQGWHDPLAASVEAVATGDPLQRQLEHFVRVARGEEAPLMDATDAARTLALVEAVREAARSGRACAPASF

SEQ ID NO: 32249 - protein, 641 aa, Pseudomonas aeruginosa
GALRSRSMQRSIATVSLSGTLPEKLEAIAAAGFDGVEIFENDLLHYDGSPRDVRRLCADLGLEILLFQPFRDFEGCRRERLGRNLERAERKFDLMQELGTDLVLVCSNVAADALGEPALLADDLWQLAERAAVRGLRIGYEALAWGRQVNTWEQAWDLVRRADQANLGLILDSFHTLSLDGDPRGIADLPGEKIFFVQMADAPLLAMDVLEWSRHFRCFPGQGGFDLAGFLAPVVASGYRGPLSLEVFNDGFRAAPTRANAVDGLRSLLYLEEKTRERLQRQTPHVAVDELFAPPPANLCDGIEFLEFAVDETLGARLGQWLQRLGFARAGEHRSKNVSLLRQGDINLVLNAEPYSFAHGFFEAHGPSLCATALCVRDAGQALERARAYGGQPYRGLLGPNEREIPAVRALDGSLLYLVERHTEGRSIYDSDFVTNDADTSGLGLRRVDHVALALPAEGLDSWVLFYKSLFDFGADDEVVLPDPYGLVTSRAVRSPCGSVRLPLNISEDRNTAIARSLSSYRGSGVHHIAFDCADIFAAVAQAKEAGVALLEIPLNYYDDLAARFDFDDEFLSELAYYNVLYDRDAQGGELFHVFTEPFEERFFFEILQRRHGYAGYGAANVPVRLAAMAQARRGVRRVKL

SEQ ID NO: 32250 - protein, 186 aa, Pseudomonas aeruginosa
RRWPPGSVPWRRWAARCARRRRRGTAGHAASARPRSCAAARCSSPAKVRSPVSPPPRTGVAPSVPSRSARRTSPRPSPTMAPARSSGCGWPNAGCTGRSRADDWRRSVRGSPAGCRRAGRASRTDRPARRPSAAPPGSIAARCRGSHRSRRCSRNPGAAVRRRVRRSRRGAHLAGRAGAPRRPGRR

SEQ ID NO: 32251 - protein, 515 aa, Pseudomonas aeruginosa
WRLESSLRIALSLLWLAGGACAGADLVWRWLYFCLPWSAIEGKLPIYFWTFIKSVRQSAISLGGLDDGFHPRRPGVQALRRSPRMADPGPAALRVDPRPQSSARLGDQAAPARRSRSVALRAQGLGAAPGRGRADSRRAAFHPVRTAVVHPWLPVLRAHRRLRADARRTVAGALAGAPRRAAPGAGGAGVVPGGRGPALYRHAVRRHRRRVRRRCAGARAVVAVADRRAGGVAGAAGDGPAGGGTAGSWSGIPIGLFATGRAAFPRAPGNRRVRASPGHLPGTPEQRGAPPQRADRTGHRAPALAAGGQARPGLHGDDGERDRRPPRLQRAGLLHPFLQAPERRLAERFPQGRLVFAAQLDDLQRASLVITRASAALDEAAARVEPQRLAVGGVDLDFQRALQGCRVLHQLPADPAPVGRRGDEQAADEGIEQADEAQRRIAVQRQPGFRGIQIMIANQCLLLLQLGFAEETVADARGLQPDGEGGIAVGGNVAADLRRRGHGGGSQREQPRIIA

SEQ ID NO: 32252 - protein, 193 aa, Pseudomonas aeruginosa
GAGWSVHDRDESCFANPEMPSKGYCVTRESPSKARSNLPRARVSASSSGPAPRAASSLSSSPATCASACSNTACAAGLRRTSTARPSSGSGRRLTQPRRTSRSMVRPSAVRSVCECSMSTLIGTSPSKAWMIRNARHSCSPSSRGASRAVSCRSRWRTISVIRYSGPWGSPSAFVSVIGPVTFLDPLSPGRGL

SEQ ID NO: 32253 - protein, 513 aa, Pseudomonas aeruginosa
RSGVGESVVAPAFFDSPAQRRRIGVAERRRSGTHLPGELFRVQAVDHQPTAAASCLVLGIEVGNHREVTDLREGEMVVQRMRAGRQRPYHLVDLGDVDVVADQDQLRHQVSGMRAEDGLGDPCGEGRGVGAQGRQALYVDRQHGPAGRRLVGAPDHVHRQSGVLHHVQQLRGNHGAPDGVVFLRWRAGDADRQDRLVAEAQRMDVEQRLRLAGGEGIAVVFAHRAFQRGFVEADLALQDDLGIGRNPQAVGLRAHHLHRLADQGAYVAGFADPLRQRHAGRRECRRRCAEGHRPGRWLALAAPLLADDADVLGGNGRTRQGVAVHQHQPAHRPAVPTAVRRLYHVETVGAEIAPAVLLMEQGDREAGQVHLLAEPDVFLHRPALQPARRDRFRAHRGAQHGHDVPRPAVFRQAEMQRQARMGAGPVGAQAGRRAQYPRAGQAVADVVEQRGGCAAFVDPAGDGADLQVGVDLGVHVHQVTLATQVVDEVAEIQGAAVHRLATPYKCVCMHLMC

SEQ ID NO: 32254 - protein, 169 aa, Pseudomonas aeruginosa
VRPMGRPLTCSTTALSMPMARIAATSAGTFQSNGQTADNASSIAQQTRIGAARRPLKRASITPSALPTTKLARATLSRTSPPKSPSPSDTARRVVLPLMKETKSPVARKPMASVMPASTDSPATRPSPTRPRVRRKRRRRALLPTMLSGSIRRNHPQEEKVRPSADSRS

SEQ ID NO: 32255 - protein, 207 aa, Pseudomonas aeruginosa
LVTGGTPSMPPNTLEALSAFIAFDRFSMRPSSFTRCARWATPMRVPAVSNMCTKRKARITLIMVTLNAPAMSIARKVGARLGGAENTPPYCTRPRAQPTRVTLRMLMRMPPNTRRYSSTAIIRKHSAASSGPGEVRWPSLIRVAGLATTMPAVFRPIRPRNRPTPAPMANLRLRGMLLSSHSRTREKVSSMNITPEMNTAPRAICQL

SEQ ID NO: 32256 - protein, 736 aa, Pseudomonas aeruginosa
GHDFLTSGSRTRASDYAFVYKKVKECLRVFRHIFISFPSRPLPGGAARSERGAERGGASDAAACVHYFAISRRRASPTPVSEDQPRPQAGRTRFETDDRSVATHQEAAAHRQGCPQRYPGRDRLRPHLRRHPRTTPGPRHQAERGGARRDIRCQPHHHSPRPLAPGPRAGGAVTAEPGRGGRQPEHRRGPADPFRPPHRRARHHRTGHRQRHRRAPGRVARDGGAGTIQLRPWRPGRRHPPVRRVPPEARRDGAQRSSGEFPAQPGVADLADHRPVRKRRSLALLVRRAQRDPRRHREGRQGARGDPDDAPHGAHRQQAQPGERQRFRRPARGVLAPPRRQEEATPGQGRQRFGGLIRSIEKPRDAGLFRFRRESVAAMHRATGGEGFLHRAVVAEDGQREQPFGQAAGLAQAVGEQRGGVVVEDHEVRLVAGGEAADPVVQLQRAGAAEGGEVERLERIEAGALQLHDLVRLVQGLQLGEAGAGADIRAQADLDLVALQLRHVEQTAAEEQVGCPAKRHWRASLRQALAFAVAQVHAMGEHRARPEQAVVVVDVQVAAALGEQLLHPLDFLEVLRQVGVQVYAGMLAQQPRRHVQLFRGAGRGEARGHCVRADGPGRASARSAPCCRGSCSRRCRSGSPARCGPSSPCRRSGAGPGAGRPRTAIPPIAGARCRRPARWWCRCAAVPAGRSRRPGRRGPCRRTGVRWGRYRCSASPAVARRRRRSSRSAGNGCGCR

SEQ ID NO: 32257 - protein, 848 aa, Pseudomonas aeruginosa
SSSSRHPPDRGGSGRLDRGVRRLRLGGLQPAHLFHAPEHPLGRRRRVDGGLRAVVGEAGHGVLDRAPDRDAEHERRLAHGLGMEHGLLRILAVLQKFHPQVQRHVGDGGNLVAGRAAGHQLALGVPDQFLHGQPAHALDEAAFDLADVDGRVQRVADVMQDVGAQHAVFAGEGIDYHLRAGGAVGKIIEGPATGLLAVVEDLRRAVEAGAGQRNLAEVGLLDQFLERQDQLADTHLVVAELDVFLADLPVPRGELHQAPLDGFGGILRGLAVQVGARGGGGGRGIGYLVGIGGGDLDALHVDLEDLGDHLGDLGIEALAHLGAAMVQVDAAVGIDVDQRTCLVEEGRGERNAELHRGQRQAFLQDRAGGIEGTDFLAAAGVLAARFQLGGHLRQQVVLDGLVVMGDVALVLAVVVELAHLQRILAQAAGHGVHDLLDGDHSLGPAETAVGGVRGGVGLATVAVDGGVAEEVGVVRVEHGAVDDRAGEVRRIAAIAGQVDLDAVQAAIVVEADVVFDVERVTLAGDLHVLHARQAHLRRTPGVVGDHRAQAGRRRGLGFLAAEAAAHAAHVDDDAVEGNPEDLGHQLLHFGGVLRRAIDDHAAVFAGHYRGNLRLQVEMLLAADVQRALQAMRRAGQRGGGIADAVLVAVEDEMALAQGLDHVEHRLQVFVLDDRRHGRLARGFQAVGGDRQDHLSDILHLAIGQQRVAGHHRADVELAGNVGGGEGDGDAGELVAGRHVEAGDAGVGALAQARIDVQLVGKLQAIVDVDRLAADVLGGAFVLDAAADPGGQLGAEQVGQLFLALVRLAMVRHRRSPGFRRRERAAPGSICAAGSARSAGDIPCSRGSR

SEQ ID NO: 32258 - protein, 142 aa, Pseudomonas aeruginosa
PCSRGSTPPAAARGAVRRGAGRSSRRGRSAAAGRRRSARRCRYCRRECPGCGSAGTRNAAATRRSPGSPRPAPGSSRSAGWRRRFPGSWRPLRCVSFRGCGRHRSSPAVRDGTGWPPAPGRCRRPAGVPADWRRRGRPGRRR

SEQ ID NO: 32259 - protein, 1201 aa, Pseudomonas aeruginosa
SPVTRRGSARSCWNTAATTASWCWPRSPNADGDPGGSARMRLKSIKLAGFKSFVDPTTVNFPSNMAAVVGPNGCGKSNIIDAVRWVMGESSAKNLRGESMTDVIFNGSNTRKPVSQASIELIFDNAETTLVGEYAQYAEISIRRRVSRDGQNTYFLNGTKCRRRDITDIFLGTGLGPRSYSIIEQGMISKLIEARPEDLRNFIEEAAGISKYKERRRETESRIRRTQENLARLTDLREELGRQLERLHRQAQSAEKYQEHKAEERQLKAQLGAVRWRDLNEQVGQRERVIGDQEIAFEALVAEQRGADAGIERLRDGHHELSERFNQVQARFYSVGGDIARVEQSIQHGQQRQRQLQDDLREAERTRQETESHLGHDRTLLATLAEEMAMLAPEQELSAAAAEEAGIALEQAEQGMQAWQQQWDAFNQQSAEPRRQAEVQQSRIQHLEQSLERLQDRERRLQEERGQLAADPEDAAILELNEQVAIAELALEELQLQEQGQAERLEQLRQELQQLAAEQHQAQGELQRLNGRIASLEALQQAALDPGQGALEWLREQGLEQRPRLAEGLRVEPGWELAVETVLGADLQAVLLDGFDGLALAGFGKGELRLLSPARGAATAAGSLLDKVRADADLSPWLARVKPVETLEQALAQRGALDDGESLISRDGYWVGRHFLRVRRSDEAQGGMIARAQELEALQERREPLETRVSEGEERLAAARDEQRELEGAREQVRRQVQEEGRRHGELKAQLSAQQAKVEQLVLRRRRLDEEVAELAEQRALEQEQLSEARLTLQEALDSMALDTERRETLLAERDALRERLDRIRQDARTHKDHAHQLAVRVGSLKAQHNSTQQALERLDQQSARLNERCEQLNLNLEEGAAPLEELRMKLEELLERRMAVEDELKQARLALEDADRELREVEKRRGQAEQQSQLLRGQLEQQRLEWQGLVVRRKALQEQLAEDGYDLHTVLANLPLDASERDWEERLESLAARIQRLGPINLAAIEEYQQQSERKRYLDSQNDDLAEALETLENVIRKIDRETRNRFKETFDQINAGLQALFPKVFGGGTAYLELTGEDLLDTGVAIMARPPGKKNSTIHLLSGGEKALTALALVFAIFQLNPAPFCMLDEVDAPLDDANVGRYARLVKEMSEKVQFIYITHNKIAMEMADQLMGVTMHEPGCSRLVAVDVEEAVALAEA

SEQ ID NO: 32260 - protein, 162 aa, Pseudomonas aeruginosa
SCMAKAGRRSSKCAARCSCPRPVSRRSTPRPWKPAARPSPTRATRRPAACASWIRRSPPVARWSSVPTASARSAGRCRTPRWASSRRSAAGVSPSVASCAWSRAPRPAATTTTTSVADAMRWPTRSTAWCSRSTASPSSANWASARASRVGRSPTSSPRARS

SEQ ID NO: 32261 - protein, 787 aa, Pseudomonas aeruginosa
KRIPRLSFIIVLTRLGIGLRNKGSNMDNNVGFIKTIKVLSDFEELVRRFVQKIYSADAYLVGGPYDGGRDLVYAVRGREVRQAIQISTQEKNLEAKLNEDLEKVVKLVDEHSYPPILIFFWSHQISASKEDELKTNARRDYGVTLEFYDANKVGQKITNEYPDILRFLLEDVHKYRPASNADVNIKQRAFYDYLVLSKDTTSLKHVIVDSHIVSVLSGGCLTEAVLVEVLGELGISLPVFKSRVSLLKKEGRVVVGEGGYSLAENELDRVKALAMKDQAGRAEVLAAIDEISKEYTSAPVAEQILELIQEAYGASVDIQISEESFEPPKLAIVKGAVENIASLLRRVSDISDNDAKHASQKLVEISAKNEYLSNYCSTRLCIGLLNQSKLERYVEDKKFFLYLDAPVFIYYLAVMRYREDVDDNAYRTVGHLRDNIKRLRNKEVRVTLEHFEETVRHLENAEKISRFASDELIASLGDSKNVFFNLYLRLKEKKGRRYEFSSFLEDFIGFENIRGGFPRFESLLLCARQYAELGGVRVLGVEQEQSEGFYRDLHSRFMRLIRVPRKWQTFKNDVLACQVLGDVSKHLDANGVFQTPLLITWDSTQHALRRIYREKFPHDEWVVYPPHRASERLSMIDLKINSEDLKDGVLAIIDEDFFKDARSGSLLDTLAIFLGDDQAESGAVVSLLTKLSRRITEEPDDVRHTDFDAQNTLNEVLIFTQREFRREFSTVRKLFAEERFVGDIYTLLSNTVKSEFGMRQKEEYAESLRTLIAQIESEERDGSEERS

SEQ ID NO: 32262 - protein, 78 aa, Pseudomonas aeruginosa
SSWRIRSLFIATARGAVECQYLGVDRREDCYKLKAGERLLLAKLLDEDYPYVESFQEGAEVSSTWAEEDYENLRRQYE

SEQ ID NO: 32263 - protein, 142 aa, Pseudomonas aeruginosa
ENRPSQFHHRSVCPGKLRQEASEDDRKRETLRGVHDMTIHIMLTVDLNGHVSTEARAKFYEVLKQYHLVRRKLTTVWTAEFSPGSTKDGAVEYVRKAVEAAAVASGVFDYEVAVLPSDVAPVTWAKSPQKLGLLGAATLLGR

SEQ ID NO: 32264 - protein, 403 aa, Pseudomonas aeruginosa
  UNSURE (271): Identity of amino acid at the above locations are unknown.
KQQHRSATEDNNNDYLRCRTAVSVYPRRADHRRDPWRAARRAGQRRWRRHRHAAADLRRQLPGQAWPALGEDRAGRGVLERGLYSHRGRHGRPAECPRRAERRAGRYPRRHRRGRRGLRPGPAARPLRPEESRRRPAIETAHQRAGVSAMFESLNKVINGYGLISGFAIIGVTMAVSYWLSARLTRGRLHGSAIAIFLGLVLSYVGGVATGGQKGLVDVPLMSGIGLLGGAMLRDFAIVATAFGVNVEELRRAGVSGVVSLFLGVGSSFVXGVAVAMAFGYTDAVSLTTIGAGAVTYIVGPVTGAALGASSEVMALIIAAGLVKAILVMVLTPFVAPYIGLNNPRTAVIFGGLMGTSSGVAGGLAATDPKLVPYGCLTAAFYTAIGCLLGPSLLYFSVRGLVG

SEQ ID NO: 32265 - protein, 357 aa, Pseudomonas aeruginosa
AGSSGHPLPEGRGLGIGQRASGNVDFRPLSRRLLLQAQAVHPALREQRQQVRVALLGLEEHHADVLLQAIARLQRDQPHAVLVDRLDAFGQQRMADPRADHAEEGEYVVHLHGDLRFEAGLLEHPGAVLMGGEALGERDEGRVAQGAEIDLGEPGVGRVHRHGEEDVIGEQRQVLAVGIADAVVERHQDGVQLHVLQLVEQIDVGAEDQVDVQRAASQLEAHDQLRHGLHRQRIERAELETLGGEAGRLAGQAHRVEYLLDQLLRALLEHVGAFQRGQVASLVLEQRAAQGAFQRVDGAVHADVAGAQFRRRARQVAGAHEGEEGFQLLEGDFFVYQHPRSPGRWRRGIVPEAAREG

SEQ ID NO: 32266 - protein, 62 aa, Pseudomonas aeruginosa
QGEGGVFELSDWQRRAATQRFIDQALIGGRQRPAASRRYLRRHRSGEQSPAGAGRGLRCGRR

SEQ ID NO: 32267 - protein, 223 aa, Pseudomonas aeruginosa
RGSGRRPPRLRRRPLGASRPGRAQARAAAPGRADAGPSRRAGAARLAEHGQAGDGRLEHRCTRRRPRLRLVCGKPRQALRPGRADRPADPGHHYPRAAGGDRRGGAVELPARHGRLEARPGPGRRQLGGAQAGRAVAVLRPAPGRAGPGGGGAGRRAERGAGPRRAGRQGPRLAPGGGRTGVHRLHRGRQVLHAVFRAIQPQAGLAGVRRQESEPGVRRLPRS

SEQ ID NO: 32268 - protein, 242 aa, Pseudomonas aeruginosa
PGGGKGRLRHFLQPGRGLFGELALAGGAFDPRRVRRAPAGQGPRLAAGRSAGPGQPRRRHRRPPADRRDSRRHRAGARRGRDPARRWPPVDDQRFGQLHRTDPVRRRTPGHAAGPRGNLRSGAGDQRLRLRGRGHTPGQRQPLRPRRLAVERRPAPCTPGGAALECRNGVGEYRGRAGRRGAFRRRQAVRLRSRPVAAFLRQVHPVEDDLVPVALKTRRTRHDSMPITTTRGRSNERHAERA

SEQ ID NO: 32269 - protein, 508 aa, Pseudomonas aeruginosa
DCPGQVRRPRSPAIPFGLTRQGNKENTDDDRSAQPAARHPRLPATGRRAPHPRLPRPEGAEPRRPAGDGPRRWPAALGQRRQALPGRHVRPLVHQPRLRPPGPRRRRQPPAGTTAVLQHVLPHHPPGGGGAFRDALQPAAGPLQPRDLHQLRLRGQRGADPYRAALLADPRQVAEEDHDRPLERLPRLDPGQHRARRDEVHARDGRHAAGLRPHRRTLLVRQRRRAEPGRVRSPRGAATGGEDPRTGRGERRRLRRRALPGRRRHDLPAAKLLAGDPAHLPAVRRAAVRRRTDRRLRPHRRMVRPRTLRLPAGHPVHRQGPDVRLHPHGRPGTRQAHRRGAGGSGRGVRPRPDLFRPPGGGGGGHRQPQGAARRGRGHAGQGGDRTLPATLPARGLRRPSAGRRGPGRRLRRRAAVRRGQGDPQALRQRERSGLALPHHRLRGGRDHPLHPRPHDHGPGAGGRACRDRRTDRQDPYRGGSHRPRDRRALTRPGGPASAGSTATRSVPP

SEQ ID NO: 32270 - protein, 149 aa, Pseudomonas aeruginosa
RARRTRRWRRNSSPSPASRRRRRCSPSRSPTGRYTRAPWRCCRRRCRRRCRPRRPTSKARGRWMPSSGWTTARSWNSVSMPGRRAERAARRQKKRRAPSRPGPSGQSADGVISAALPTTPADTDSPRYPAPAPEGAAPPPPGRRGPGRP

SEQ ID NO: 32271 - protein, 540 aa, Pseudomonas aeruginosa
NPLPARSGATLRPRWRQRRPRRLHSPDPDGRRPRADPPGQERPDADPHDSRPGLRPADRCRLREEAGVLLGRQPRRRFAAPPARRGGEGLAATAGDRGTQPRRPRQRLCRRRLRAALRSAARLRRLRPAEGQPADPQRHLPVHRRSAGGGALGASGRQRDPRAEGRPQGQRAALGHPRRAEGSGPGGEALHRHRRGDRRRTGRPDERLRPAELGAQRRVPGARRRASVLCPRLLRARQPLLPGLGSDRPRPRKLHRVDRRIHPGDRGFRGLPGQARGGQAMSSYSTNEMMTVAAARRLHNGAVCFVGIGLPSKAANLARLTSSPDVVLIYESGPIGAKPSVLPLSIGDGELAETADTVVPTGEIFRYWLQGGRIDVGFLGAAQVDRFGNINTTVIGDYRQPKVRLPGAGGAPEIAGSAKEVLIILKQSHRTFVDKLAFVTSVGHGEGGDSRQRLGLPGKGPVAIITDLCIMEPEAGSNEFVVTSLHPGVTREQVVEATGWAIRFAERVSETPAPSEVELAALRDLEARTAAAHGQKGSDE

SEQ ID NO: 32272 - protein, 504 aa, Pseudomonas aeruginosa
ASAKAWRWPSSGSDWHNRVARPVSRARVARRCPCFGGGAARVQRNRTLRRTVRMKRTLSREQQHDCPCSPVQQRRTPQAHLRHRRRLLRQPRGMVRLLRLRLLRDLLRTGLLPLRQPHGAVAEHRRGLRRRLPHAPHRRLDVRPHRRQARAQDRHADLGGDDVRRLPGDRLHAHLRQHRHPGAGPAVAGADVPGPVGGRRVRHQCDLHERGGAQGPARLLRLVPVRHPDRRTVAGGAGGGDPAAVAERRRTARLGLADSLRDRRDHRGDRPLAAALAERDRFEVDPGAQGIRHLRRAVQAQAGLIHRARLHRRRLADLLHFHHLHAEVPGQHRRDERQDRQRGDDLRPAGVHADATAVRHAFRSHRAQDLDALVRHPGHAVHPADPARAEDREQSLHGLLPDHPGAGHRQPVHLHQRPDQGRDVPAGGARPRRRSVLRGGQRDLRRLGRVRRPGAEVGRDGERLLLVCFSHVPAGAAGLREPAGPAQGQLPERRALTGREKENR

SEQ ID NO: 32273 - protein, 323 aa, Pseudomonas aeruginosa
  UNSURE (223): Identity of amino acid at the above locations are unknown.
CRFGIGMFDILFFGQRGEVPILPRDPGAKPGAESPQEQQATSRTHSMKKMMQGAAALIALVGAGESMALEWMSNSVGFRYGQQFTNPNNPDKFAKRIYSFTHADGYRYGSNFFNLDVFLSDNRDPRKGTDHGGSEVYAVYRHQLYASRVFDRPLGTGLVKDYAFTLGFDASRNNNLASAKKRALVFGPTLKFNGPGVLDLSLLYYREKNHFGVPGARHPDHTXDTTYMLNLTWMRPFKVGNHAAKFQGFVNYVGEKGEDYNDKDTAAETLVRTALMVAALPGDKRQPNLWLGVGYEYWHNKFGVDGGTGSRTSTPTLNMEFTF

SEQ ID NO: 32274 - protein, 286 aa, Pseudomonas aeruginosa
NLDLRQAVKIRNQILESCLPSTQERPSMAGSLIERALGLLELLASDARGLPLQQLADRLDIPKSAAHRMLAELIRLGYVSQDHDTSRYRLSTRLAALGFRFLASSGVVDLVQPVLDGLARETGELVRLGVIEGDRQTWIAKSQGATSGLRYDPDMGREAPLFYTASGHAWLASLSHKAALALVERQGVGAARDFGPNAPRSRSELLRYLKRAREHGYAWQIECSAPGMAAMAALVRHPEDGRALGVLSVAGPSARFGEARMHELAPLLLAAAQDLSHASQASELFR

SEQ ID NO: 32275 - protein, 109 aa, Pseudomonas aeruginosa
CMESRILSLAALTVLELSPPDMVEAAARAGYSHVGLRLVPATVEEHHYPLLADAGLRRRTLARLRDSRSAHAGRGDPAPASGHPRRRVRRGAGGRRRVRRALCAGGRQR

SEQ ID NO: 32276 - protein, 304 aa, Pseudomonas aeruginosa
PAIDLPWCPDPPMNASTSPLPASDQTLRGILLICAAVFLFASHDGLSKFLSGFYPIVMVVWARYLVHTLLMVAVFVPRNGLAVIRSRRPLMQLARALCLIGTSLFFTTGLRYLPLAEATAVNFLAPLLVTALSVPLLKEKVSLGQWLAVLTGFIGVLFIVRPGGALFTPAALFPLGSALCFGLYQLLTRMLANSDSPTTSNFLAGIFNTLIMSLLVPFFWQTPSLLHGLMMIALGGCGMGGHLLLTQAFRHAPPATLAPFSYGQIIFAGLLGLLVFGHVPDAWALLGILVICASGLVVAWRRGR

SEQ ID NO: 32277 - protein, 454 aa, Pseudomonas aeruginosa
AGRCPASAGRLDSGFDPARSHEVQPGQGDEVHRRDHGEEHRVVVVRRGQYAADDLGHEHPAQRRAHAAEAEHRAHQVLGRVVHHQAPDVRRPRLVRADRQGDGQHGDPQAAGVGGEHHADDGAGEQQHRQQARADRRHAAADQPGRKDAAADAAEVGGQPDQDQRDAHLRHADAQAVLLVEERRQPVEVEPEHRRGDRVGQGEGPGAAAAENLREGHAGGGRLLLLLDVFQLALLHPRMLLGVVVVAPPEHQPDQAQRRHAEERRLPAPDAEDQRQQGRGDHRADIGAGVEDAGGHRPFPGGEPQAGGLHAGRVVGRLGQAEDEATDHEARRRGRQAVGAGGQAPEQHGEEERALDPDLVDEAALEDEADGVADLEPEVDVGVVHCRPAHLLGKDRLHHAEGGAIDVVQGGGEEHQGEHAPARPADGEGVADPAAAGFPRGVGGEQSRAGRVDH

SEQ ID NO: 32278 - protein, 180 aa, Pseudomonas aeruginosa
SSTASTPSRWTAIPAASPIFRGKRSSSCRWPTRPCWQWTCWNGAGTSAASRVRAASTWQASSRRSSRPAIAVRCRWRSSTTASAPRRPAPTPSTACARCSTSRRRPASACNARRRTWRWTSCSRRRRRTSATASSSLSSPSTRRSARALASGCNDWASPGPVSTVRRMSACCARATSTWC

SEQ ID NO: 32279 - protein, 136 aa, Pseudomonas aeruginosa
GCPRGPGARAGSTSNRTSRSTPSASSAWATAAPAPPAPICTTRWRGASARPRRKPSAKPRQSVLWPMRRPSRSTTVFTAPMPRASAERSSSRGMIACLQGKVTFSPVKPRSLAAASRNSRSSADLPSGSRSISRYR

SEQ ID NO: 32280 - protein, 632 aa, Pseudomonas aeruginosa
RCRRPGRGPGGSSRAVGLPGWSGGSPRRSRASRRRPRIRRRFRPGSAGRRSVARGCRADSGWGRSGPVPCASWRSLHSNDVIDAGKMYRTVTFVNRTPSPTGRKRSIIGVRSLACRRLRRAAAAQGHVGQCRGHRQAEQRHRRVDQEEHLEGIREDMLEDHPGRPAGGVQAAQQGALGKALVEPAADPQVLEQGQQDRRHQRHPDRPAEGAEQRRIAGGDADVALLHGVLRGHQAGRELGTDGDPGEQHAQPGQPVVADRDQGQAGDAAGQQDGAEQDQRLVASQAGGQPPAAVRAQRQAHDQRQQMQRGAVGAGAGNALVAQRYQHGQRDGLEAGEERNQPTEGGGADGEQLHRHQRFAEAPLLGDEQQQGERRQGEQAEQRRVAPGCALADLGDGQEQRGEAHHHQHDAQVVDHRLPARHRQADQGSPRDGQREKADRQVDPEYPAPRQVLGEQAPEHRAGDAGDGVHAAEVTLVAAALARRDDVADDRLAHRHQPARADPLQHSRQHQLAHALREPAKQRGGGEHDDGEEHQTAAAVEVAELAVDRHRYGHRHHVGRDHPGQQVEVGEVGRDRRQGDGDDGLVEGAEEDRQHQAGEDGTDGGRVLGEIGQDGTWGGRNAKAAGIILRLG

SEQ ID NO: 32281 - protein, 435 aa, Pseudomonas aeruginosa
DRCRGESIRGPSFVDIRLRQRCFPPWERCPGVAPGWRGLLDFLVGQADIILGDGRQARLGAQVVLQFGLLDALAERVGVGEAMQHRSHPPGEAFGLPDPPQADCRVAFQQFAAPFAVGLQQQPVERADVAGRQVQSLGAGGRHDVRGVAGEEQPAMLHRLDHEAAQRRDALLQRRSGHQFLRHLGRESRLQFRPEALVGPVLDLLRQWHLHVVAAAGGRTLAAQGEAARMIGVDQFVAHRRGVGEQAEPAERIDPLEDLQPLRRDRLPRDAVEAIAAGDVVAIQAQPFAVAFEGHVGALTLQVVQAHLGGLVDGSGAAGFAGLHEVAGDLGLAVDHHRLAAAQALQVDAPALPGEGDFHAFVDQPVARHAPVDAGLAQQVDHTLFQHAGADAAEHVVRGLAFEDHVVDAGLVQQLAEQEAGRTGADDGDLSLHCG

SEQ ID NO: 32282 - protein, 301 aa, Pseudomonas aeruginosa
SLFGNRPFRSEGSMTDSIRDVPVFKLYGAPLEWPTPDLLHCESIPARSRLHDWEIKPHRHADLAQLLYVRKGWAQLQVEGEPTRVEQPSIQFVPPLCIHGFQFSERIDGYVLTLAAPLLARLQAHLGAQRQALEAPGLYPVGADRRYIDTLFDAIDGEYAGAAPARELLLQSLIGVLAVWLGRQVMVRRAEARPGRGQEYLSAFSQLVERHFREHLGIDEYARRLGISPAHLNSVARRLSGQTALGIVHQRLLLEAKRDLVYTAMTVNEIADRLGFSEPAYFTRFFKRLSGVSPSAFRKGD

SEQ ID NO: 32283 - protein, 246 aa, Pseudomonas aeruginosa
TRRVMAPISRLASTSVCTSTRSPWRRRWSTKWRKSRALRFIGSPLHISACACILCADAFFRQAEPGRFAGWPEGRHLGKIYGWLEALASFLAQSRHRIGERRRGGNMEACDTAGIMDAITAVTGVLTLLVAWAALFSWRRQERQKAILAWKADLVDYAYGFPNLPVIWGYQTHKDEIDQAAERFYRCVKSYMVMRELVSRKRMKAYERIWRQAHFVHEKCTFEGQMTCAIARDLLSQAYLNDFLKS

SEQ ID NO: 32284 - protein, 450 aa, Pseudomonas aeruginosa
EKLPGLLVGPHQKDVDAMLVLPDMGHFVNEQTLALQALQAPVRHAAQLLAEVDVAVRRHHVVLALPGDIVLVAQADRGIVDGIAEYAFRQADFPFAESTSGLGVGATQELADCNRRANRRCYPGNCGGGRFRVFHIDLGDVHRILLQQLGSAFGVGDALDDLAVGHGDGIGHVGHGRLPVQLLEDEPPLRLAHLELRQLGFQAGRADMTVLRRLDHEVAGHAQLDVAALEGQVGAAAHQGDVLLRGDQHVLLAGADLHALLGFQADVVLLRLQQHRALVGDLAQLAALGEQADVAAGVDHHLLPGGHLLVLPGHAVDVLAGGQGQARRRRRGDPCRTAQGDRRLASVALAGLVVGTVAEVAHGFLEGLLRRRVVPHALVLPGVVAQLAGQLQRRLQHLHHDASVEMAGAGPELLLGAQQQPLGRTHRAMFVGAQFEALAARLAAFGPRMG

SEQ ID NO: 32285 - protein, 593 aa, Pseudomonas aeruginosa
VAQVQRAGTVVAHQRRTDLRRGVVDAQLVGPTALVLLALDGAEDLVVGQRVGRSVGRPVGAPGDDRLVAVAVQVIDDHLLANPRDRHVSPVGTRPVLRDPYPAGTELIVTSLAIPGELDFHPSPLVAMDLFPCRADYRRDLRTIDTWPRQRCGTPFDVLGYQFGAQVVAHPQRGVGGLFLLAGILGAAMDHPHRPPPGVEVGTRMTFHGKGVARDQPRVVAADRCHPRIAPVPSEAAFAERPAGAALLVATGVVVALVGRALMLERLASEMMLLVVGRALEAVVPLGLSSRTNIFAVAERMKHRLRVVALRLGAEQHRAAGDTLLDVEPVAADQGVAVFVEAEVVDQAFLEGQPVVQVVIAVAGLHAVFARQVLMVDALFVVEHPVFLEQRLENLRNTLLLEDPPVAAQLQARQLWFQQQFVAGPAKTRAALGEVADDAMDVAGRTAVLPEGEGARLVEYLLEIDGVLVAGQLQVQAERLAERFFQFELDDIEREFPFADDEGEFQVPLTHGSFLVPGGRFLPHPLEKRAPRYSCSAAAESLGSVSISRSSGHFRLDGEPIAQVYDRCACQLTLRPASASRRSRRCRRLRGSR

SEQ ID NO: 32286 - protein, 466 aa, Pseudomonas aeruginosa
GQQGCSAAGNRRCGSSPFGQGSVDLCALGDPAADQVAFFLGHLRDVAQRHDLRGHGLGLDLRCQLLDLLRGVEHDPAWRGAEQLAGRFRRVADGAALLDHVMDLVEVGSARGPGIGGLGRGGRGWCVAAGRRLCRCRRRGAGQRCGSLLVVRRGDEGQGDHAQRAGGQCPGEAVAFVAGVEVVAYQYREHRDGGQDQPVVLAAVGAREVVADHDEQHRQGEVVVVPGAQQALGRQHRIGLAVFFDGFHQRALGRHDHPEHVADHDGADDRADVQVGAAAAEHLGQAVGGGDQQDEQDQAEQGRGLAQRRIAEDGVDEPAADQRTDTDGDGRRRRQVAAGGDQVEGRVQVEHDGQQHHPGHPGGVGLPFEPVQVLRHFRRSQLVLLQVVDAATVDCPEVSGQAFTRVAAVEVVLQPDEIERSADPRDPDDHVNPAHQQVQPFDEMCFHSLVPLALAGGPAAGPLLLV

SEQ ID NO: 32287 - protein, 275 aa, Pseudomonas aeruginosa
ARISPGHKPDAQGSRPMTDQLQHIRKPPRTGKAARSGTQDEIVYAHIFDAILEQRLAPGTKLSEEALGEIFGVSRTIIRRALSRLAHEQVVLLRPNRGAVVASPSIDEARQILFARRTVERAITELATDNATAERLAELREMVVQEQSSFARGDRGAGIRLSGEFHLKLAEMARNAPLVSFQRSLVSQTSLIIAQYESGGRSHCSFDEHNEILDAIEKGDKERAVTLMMHHMEHIDSKLNLESDNASGDLHAVFSHLLGGKKKPRRAKADSDSAA

SEQ ID NO: 32288 - protein, 552 aa, Pseudomonas aeruginosa
EQTALAVPALDQRLAVAVAALGGVGQVVRRVAVHHHLAGDQAQVQAPGGLEQRFHRLPVHAAEDQRGGGAVAQQFLQEDLGDLVGVGLVAELAFGGEGIGVQPVQQLLAVGGDHPGLREMDVGVDEAGGDQRVAVLEDLDVADLAEQGLGVTEASDLAVLHQQQAVLEVFIGAFDADLRGVGDAVQDGGAVGFGVAGHGSLEKKRFVGGPPPGGGRGGAGGRSGFVGAARLRGQPGDARRPLLAFQAEGGVVGGDHLAGDGDGDLRRQLAFHLIQAHRAAHPLQAFGVDATFAQAVLELDALGLRADQAEVGEVVARQDRRGKLQVQRVVVGHDDEVAAGRHPLDLVEHFVVHHFLHAVGQERGKFVFPRIDPAHPAGQAGEQGYQGATDVARAEHGDVCLRLAHRLEQQHRGAAAALAETGAQAEALQTGVLGPRGEHFPGNGLGPVFQVAAADGVVEPLGADHHLRAGVARGRAALLDDSHQDARFAATLQLGQGADPVHLVILPIAAVQAGSTAASAACAWAVFNRRICSTPQSTRSGVAGASMAGCAR

SEQ ID NO: 32289 - protein, 71 aa, Pseudomonas aeruginosa
LAGPLVISLPLAFQTSSSMVSQPMPWTKPPSTWPMSMAGFSESPTSCRMSVRSMRYSPVRVSTITSEQAAP

SEQ ID NO: 32290 - protein, 569 aa, Pseudomonas aeruginosa
IASPLTCLGALSCLTLRPTPVVNSARNRSASSSWLLCGLRWLDIGGHPGFDGGSVQLQEAFAQQVLRGQQAIFLARAEVAERGEVVRQGGGGAFEAGGFQARALQRRFAGGGALGNRRHAAEGDPGADDPAIFQVEADGGADRGNIVVDALGDLVGLERLAGPGTRDQDLLDELAFFAGGDLVVEEVLLQRQLAAPFAAAQDDLRAEGDQQRRGVADRRGVADIAAESALVADLQGRETLQQLAEVRVVRGQRLVAVGQRGGGADFQAVGAHFDAFHFADVADIDHHRQFAMELGGLQRQVGAAGQQACLRIGAVEVGQVGDGERQQAAPVTAVQLGGFARSDVAQLLDGGGFPGVELVCAPVAAGLLGGVEDRPVAGAAAEVAGERLVGLGRIGAGAVLLQGEQRHDETRRAEPALRAMAVDHRLLHVVQAVLVLEVLDGDQLLAVKGGNEGQAGVQAAIADAFGTILAGDQFADHHGAGAAIAGGAAFLGAGLAEVPAQVVEDGEVGVQAFFDADLPVEQEPDQGVPPGGFLLLNSRPCRRTGRSGAVSAQGSTVGAMEANLEKTDF

SEQ ID NO: 32291 - protein, 195 aa, Pseudomonas aeruginosa
KDHHDVQGPGQPGRADRPPPRGTHHPGRTQGTGTYPGAEGHPDPQRQSRLGPRGAADSRTPPPGEHPAAPRRPGVRTVPATCGKPLRADRAALHPAGGKRRPALAQRSRAGTVPGHPAAPAEQPGAKRYRRLRRGQLRHHARGLSFREQSLPAGDRRKPAAGGESRLPPGAGTAQGGNEPVPRQFCSAPASGDRP

SEQ ID NO: 32292 - protein, 249 aa, Pseudomonas aeruginosa
TSRSVSASGSSATRRSPSRPWWPSSAVPMPASNGCATAITSCPNASTRCRHASIRSAATSPGSSRASSMASSASASCRTTCAKPNGPARKPNRTSGMTVPCSRPWPRKWPCSHRNRNSARPPRKKRASPWNRPSRACRPGSSSGMPSTSRAPNPAARPRCSSRASSTWSRAWSACRIASGACRRSVASWRPTPRTRRSSNSTNRWRSPNWPWKNCNCRSRAKPSDSNNCARNCSSWPPNSTRRRASCSA

SEQ ID NO: 32293 - protein, 295 aa, Pseudomonas aeruginosa
DPHAQPRQRLRGAGPAGLRPPRTRRTGRPVAWRRPARRWRGGRVQLRAEAGRPGRQPALRARPTGARRHPRRWQHRRGHHQQRTHHSQRTSEAAWRRLAGDPRSARRGVHVQGRFRGAQRQGRGNRRQDLRQPAQRGGRQPAPAGFEDHRQSPAGVLCLRLRPGQRVAAGHPGGHPRGVPRLGYPHQSRAAPGQGRPGLPRLLRRHRSPTRCAGLRDRRRGVQGQPHRLPARTGLPRARAALGDRPQVPRARGADRAAGCRVPGRPHRRRDPGGTPQAGAGGRRHGVQCDPAQHG

SEQ ID NO: 32294 - protein, 197 aa, Pseudomonas aeruginosa
VRHALAERAQGGRRPASGRADLGADRHPGGDEPGRGQGQAGRARRQGGRLGVGQDPLRGRRARRRLEAGQGQRAGREGARRRRPAETVRRARRRPLKRRRCCERFPKTGVNDGQGKKAAVAGRARIGGAVRRLRGLERAAAHPAALQWPGFGADRLQLQGAGRGNLLRGDPARPGPRVSGEAVRRQRLPDRLLLPSR

SEQ ID NO: 32295 - protein, 72 aa, Pseudomonas aeruginosa
TLVATRSRGKLDFWLPQLLPGGLVHSTLRGIDMSQKRSSGGKKTVHRSSITGRFVPESYAKKHPKTTEKEKL

SEQ ID NO: 32296 - protein, 105 aa, Pseudomonas aeruginosa
  UNSURE (69): Identity of amino acid at the above locations are unknown.
SHGHRPDRGGRARPATDWPSVSDHRHRRVYPLRARHGRHAGSAVICFGRPVPCACRLRQASLAGGSEHXNGVADERQAQAALPGQRGRVQERSATPMLRAAWHPA

SEQ ID NO: 32297 - protein, 326 aa, Pseudomonas aeruginosa
  UNSURE (60),(68),(92): Identity of amino acid at the above locations are unknown.
LILRVRGEHPPIYLANVNAERQLVVAGSEADLPAFAERAVPAGASAAKRLAVSVPSHCAXLDEPAARXAEAFAGIRLHRPRVPIHEQQPGAXGRRTGRAGRRSRRQHGAPRRVAGDIAQRLRARCPPASRAAAGTGPQRSGAASVRLRHAGLRRLPGGYPGRAVARGGKENPISVRSRHKNNNIDPQPRTTIMIIYGVALLSLCTLAGLIIGEILGVLLGVPANVGGVGIAMLLLIFVGSYLGKRGLLSAKTEQGVEFWSAVYIPIVVAMAAQQNVLGALSGGPAAILAGIAAVAVAFALVPLLDRFGRKKAEGARPLKPRTSVQG

SEQ ID NO: 32298 - protein, 475 aa, Pseudomonas aeruginosa
SAAASVQPPAGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQTLATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQIAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 32299 - protein, 484 aa, Pseudomonas aeruginosa
RQQEDDRMNDTPNVREPALRRVLGLGPLLAVAIGLVVSQGVMVLMLQGAGTAGLGFIVPLGVAYLLALSYAFSFSELALMIPRAGSLSSYTEVAIGHFPAILATFSGYVVVAMFALSAELLLLDLIIGKVYPGALPPMLVAYGVLGLFTLLNLLGIDIFARLQSALALLMMIVLLVLGLGAVSSDHASAQTALASGWNPLGVSALALTAMAVWGFVGAEFVCPLVEETRRPERNIPRSMILGLSIIFLTIALYCFGALLCIPQAELAGDPLPHFLFANRVFGEYGQLFLVIAAITATCSTLNSSLAAIPRMLYGMAQNGQAFPQFKQLSRRARTPWVAVLFVAAITGVQIMIFGQDPDSINLLLLAAALAWLLAYIIAHVDVLALRRRYPHIARPFRTPLYPLPQLFGIAGMIYAVVHVSPTPEMTGRIFASAGVVLGVVSLVAVVWIKGVMRKPLFVPEPLETAGETAQGKSVALDPLQSPSA

SEQ ID NO: 32300 - protein, 470 aa, Pseudomonas aeruginosa
RAKGTRRTQTMTAQLNPQRDTRDYQQLDAAHHIHAFLDQKALNREGPRVMVRGDGLQLWDNDGKRYLDGMSGLWCTNLGYGRQDLAAAASRQLEQLPYYNMFFHTTHPAVVELSEMLFSLLPDHYSHAIYTNSGSEANEVLIRTVRRYWQILGKSQKKIMIGRWNGYHGSTLGSTALGGMKFMHEMGGMLPDFAHIDEPYWYANGGELSPAEFGRRAALQLEEKILELGAENVAAFVAEPFQGAGGMIFPPQSYWPEIQRICRQYDVLLCADELIGGFGRTGEWFAHEHFGFQPDTLSIAKGLTSGYIPMGGLVLGKRIAEVLVDQGGVFAHGLTYSGHPVAAAVAIANLKALRDEGVVTRVREETGPYLQRCLREVFGDHPLVGEVQGAGFVAALQFAEDKVTRKRFANENDLAWRCRTIGFEEGVIIRSTLGRMIMAPALVAGRAEIDELIDKTRIAVDRTAREIGVL

SEQ ID NO: 32301 - protein, 432 aa, Pseudomonas aeruginosa
RAPAARPRPGRLRHGASPHNDDAAPGDRARNRFGLWPATASATSQQCQSAVGVFHVQVLAPVRTRVFPVVPVRPGVRRGGPGAEPEPDGDLLRRRDQGRPGTGLFQTLRAKRRRAGGRRRIQRRNGQGEGHGRRRQGQLGRGRGGEPRTAPRLRRGAVRTPRPGAFRRPRAVRPRHFQRVRGGHLRLVDGDGLRLDEAGQGAAVLGGFLERPRVPRQAWPAQGRQVHPGSGVAGRRGEGGGPLQGTCHPGGGQPRLRQARPAQAEHPVVGGRRPAAAMAGGRRRGDERGLQRAHRRCAEGGGETGHRLARQSLRSGVLGGGEGHAEQGAGGEIHRLRQPAADAEGVLRADPLRAGTQGHPGVAAEDGAGGAADRAGQPRRRAGGGCRVLGGPRRGAGTAFQCLGGALSALRVGKKNDGPQVVRARRVKALTG

SEQ ID NO: 32302 - protein, 298 aa, Pseudomonas aeruginosa
SAQLFQQPLQIPTALGIQRLHRKARRPHLQAGEAQAGLDGGRQAPAEDEVEQRQLPVEQRAGLLQVAVEHRLVQLAVERRDQVRRGAAPAFRAGHEGLQRQRVAAVVEGHPAFAEQAQLVHALDVAGALLDHGYVVHFADDAQDQFHRHVDAAGARVVVEHHRHADSFAHRAVVLEHFRLVELPVGDRQDHHRLGAEGFGELRAAHGLGGGQVGDADDGRHAMGDGLQGEVDHLVPFRVAQVGAFAGAAERGDGVHAAVDQALDGAAEGRQVETSVGGEGGDGVADDAVDGCGHWMYP

SEQ ID NO: 32303 - protein, 193 aa, Pseudomonas aeruginosa
QEKSFIAIGRRLSSMSMRLKLLRKKLGVTLETLADKTGLTKSYLSKVERGLNTPSIAAALKLAKALNVQVEELFSEESDGVDGYSIVRRDQRKSLSSGDDGPAYASLAQQIGARALLPFIVHPPRDFSHSTFKEHLGEEFIFVHEGQVEVDFMNQRIILERGDALHFNAQKPHRIRSLGETQAELLVVIHSDE

SEQ ID NO: 32304 - protein, 307 aa, Pseudomonas aeruginosa
ALGPRRKVLVTCRPGSAQQDETRPMAEILSLREAVRRFVHDGDSVALEGFTHLIPTAAGHELIRQGRKDLTLIRMTPDLVYDLLIGAGCAKKLVFSWGGNPGVGSLHRLRDAVEKGWPQPLEIEEHSHADLANAYVAGASGLPFAVLRAYAGSDLPKVNPLIRSVTCPFTGEVLAAVPSVRPDVSVIHAQKADRKGNVLLWGILGVQKEAALAAKRCIVTVEEIVDELDAPMNACVLPSWALSAVCLVPGGAHPSYAHGYYERDNRFYQDWDPIARDRESFTAWIDEYIRGTEDFGAFQAKLAEGKR

SEQ ID NO: 32305 - protein, 210 aa, Pseudomonas aeruginosa
RLRARPEDRGHHHRLALRQSADEGAVRHRPDAADRRQRRRRLSRVACRPGCLRPAQPAARRQGAGGRFLRRGNRPGDDSRAQGRHPGRARRASASRHHPGGAGPAQAGQRAGEDRHRRQRVRGQRRRRRAGPGLRRGSGEARPDSARAGAGHGQRRRRPTDHGHRPGAGGAQAAAAPGPGDRRLRRDRTQRSLRQPGPGLPARTGRGRRQ

SEQ ID NO: 32306 - protein, 441 aa, Pseudomonas aeruginosa
NGPCRENNSMTAPVHQYSNEERRKRIFAIVGASSGNLVEWFDFYVYAFCAIYFAPAFFPSDNPTVQLLNTAGVFAAGFLMRPIGGWMFGRIADKHGRKTAMLISVVMMCAGSLAIACMPTYASIGTLAPALLLLARMFQGLSVGGEYGTSATYMSEVALKGQRGFFASFQYVTLIGGQLLAVLVVVILQQLLSEDELRAWGWRIPFVIGAITAVIALWLRRSLNETASKSTLERKESGTFAELFKHKRALFTVLGFTAGGSLIFYTFTTYMQKYLVNTAGMSAKTASAVMTFALLAYMLMQPLFGMLSDRIGRKTSMLWFGTLGTLCTLPILLALKTVSSPYMAFFLIILALAIVSLYTSISGLIKAEMFPPEVRALGVGVSYAVGNAIFGGSAEYVALGLKSVGMENVFYWYVSAMCLLALLVCVSLPDLRKVSYLNDEP

SEQ ID NO: 32307 - protein, 256 aa, Pseudomonas aeruginosa
RAGKRKTDERHTRQPVVRCLFHGGADARGVLRPRPPARHARLRGRHGPRRGAHRGGSRDGGGADRGGLPRRTVRPAGAGRGGRHCRQLGDPAGQGAGPPGGGWRRRGRALRASRRHQPGRHGQRPGAATAPCAGLARAGSATSCRGPGGPGRTACRHAAGRAHLVAARHPGDPGHEARRPARCLDPAPPAPARVAPAPAGAAIRRRLGDARRARRTGPAGGRGAGRGAGPGSARTTLAHPARPPGGIRQRARPGGR

SEQ ID NO: 32308 - protein, 622 aa, Pseudomonas aeruginosa
PRQVRSRCQPADADRGRRGLRAGRRRARRFLDHAAQAQPGEQRGADRRRHPCAGAGLDPVRGDAAGTRAQPRSLARRVGNPAGTLLPGCRRAATGDRPARRPGGGRPADAPQPWPDPRPGARRGGEHRPGPPYRPRSRAPSGGTVLPPRRRAAPRVARGARRRGAGERRVVRRRTGPPARSRPLPRPGPRLGRARARRTPCPGLRTPSRLTGDPLRANRTPRRRRPELLPGRTGRRAGPAVVKLAGHRPGHVGHADPRTHRPFPRAALRHPRPRRLAGHPRTVRHRPARRRRACLARCPRAAARAFLRAVHGRPDRPVAGHPRRRAARPAGAVQHRGEDCQRRGLEHPHRYRPERRRAGHACPARRLGGALVHRGLRRARTGAGRAHRRDARGHLAAGLRGQLRCGTRRRFPRAARAGPGADADRRRQPRCRDHSGQRPLHAGAHRRRAVGRVRRRAPVQRRSGRRLQPPPGRFPAVRLRSPADGRETTLRSRHASAPRGARRRPCRAQPGQPDAVQRRVPGNDHPPRLGRHLDPSGAAATHPQPGHHRHADRHEPQRGTQAASARGEEQRGEPRRDQGSDHAERHLLRYSRGQRDLPPRRIGVGRAWRGVAAGVPVGRRRR

SEQ ID NO: 32309 - protein, 428 aa, Pseudomonas aeruginosa
GEWRRRRYPPIPRGPTAVIRPARGPARRRFPLPFAGVSRKVDSSVIPSVRHEPQAAYPRARDPLLRHGSPLPFDPRSRAAPERRLVGGEPADPQAGGRDRRAAVRPPARRPAPDRSRGDLRAPRHRGPAGHGARAFRTGRAARPAHRPCGDRHHRSGDQRPAALRAQGDARTLLGHHRRRHPARFPGDTRGGEQWRGRPRPGLRPAAQRRPATGQRRPFPPRCHRLPAAPVGATPGHRLRRLRRTWPDHGQERAVHPSPAGAAPAPFARTAPGGAGEQLPGAVATTGAARARRRLPDPPGDRGRHRPGRAAFPAAERQWRHPQRPRPLRAHRPLPAGGGGRPGPADRRGSAPARARGSAPERGLSGARADARRLARACPSADAVSASVCSIFCSLVSAAKCRYCPATPARNRGLSRHKNNKQPAGHTA

SEQ ID NO: 32310 - protein, 248 aa, Pseudomonas aeruginosa
RADSGRRNSRTTARTSGTRPPSSIRLCQPNSGISFAETNPPQAMPRLKPQNMLVTSSDLRRSGVYSESRVVALGIAAPRPRPVRKRSASSCSNVGAVGRGQAEQAEEEDRRDQYQLASVAVGQRSGTEGAEDHADQRGAHHRTEAGAVDAPVLGQRRSDEAHRGGVEAIEEDDQEAQQDDPPLVRRKRLGIDEGLHVESFDGGQAGAVHGTGSAARVRAWDEGRTRGSGAGGGRQGVLRHVGIPLLFL

SEQ ID NO: 32311 - protein, 171 aa, Pseudomonas aeruginosa
PRPAPPPVRGSAGGAGAGRQRYPWPAQRRQHRAAPALRQWRPGQPDRLRRCGGALELGAGSRGEPGLSTPGRATLLPAGRHRGCPEPSPAPPLALRRGPAGLARPAGGQRGGRGDRRPPTTPARALRPGRAGRGSAIDGCHRRRSHPGAGRGGSRGRAQWPGLRAGQFLNR

SEQ ID NO: 32312 - protein, 274 aa, Pseudomonas aeruginosa
GSAWNRGFFPWRRSPCSSCRPRTWSRLPPAPATVMSACAWCRPPWKSTTIRCWPMPACAGGPWRGCATAGVRTLDVEILRLRPDTRVGEFAAVLEVGAEFGARYVLVAGNDDDERRSADNFAALCDLARPLGLDPHLEFMPWTGIRDLRQAARVVEAAARDNAGLLLDAFHFDRSASSLEDLRAIPPARLGYAQLCDVVGPRPTSMDEILRQAREERRFPGDGGLDLLALLRALPENLPLSLEVPALDLLARGVDGAERARLAIERTRALLARL

SEQ ID NO: 32313 - protein, 400 aa, Pseudomonas aeruginosa
PLRQRAPAAEHFRGPQHRHRPFAVQLSRFRRAPHRLRLRRHLRRRGPGQGGRGRTAGNPAELLRRPRRALRLRRRVPQRTGLLQRPLRPRRPGRRAVPCVHRAVRGALLLRDPPAPPRLRRLRRGQRAGAPGGDGASAAGCAPGQAVRIVGAPAGALPTAGRAPHNRPQFPPATSESPMSKPDPAVVEESAPRGKGRKNNPEKTRQDILRAAIDEFVAQGLSGARVDTIAERTHTSKRMIYYYFGSKEQLYQAVLEKLYSDIRGIEGTLRLGALPPANAMEKLVEFSFDYHDRHVDFVRIISIENIHKGEHIASSELVQSVNSSIVQSIAEILRRGEAEGVFRAGLEALDVHMLISSFCFYRVSNRYTVSRIFRTDLHDAEVRQRHRRMIGEAVLRYIRA

SEQ ID NO: 32314 - protein, 62 aa, Pseudomonas aeruginosa
RPRSRGGTMSPMIAWLTAISPPAPIPCSTRASTSWPMLCASPQSSEAAVNTTMAKSIRRRRP

SEQ ID NO: 32315 - protein, 97 aa, Pseudomonas aeruginosa
RIPSATSRCSSSTALPSNGRPRTCCTASRSPPAVVCTTGRSSRTGTPISLSCSTCARAGRSSRSRASRLASSSLPSSSYRRCASMASSSPSASTATC

SEQ ID NO: 32316 - protein, 137 aa, Pseudomonas aeruginosa
RRCRCRPGSASAPGVRHASRRRSRRPVRRRPRRRCPGPPGAVRRSTARPSRSPPRRSTRPCPPAVRRSAPRPAVARKSWCPRWCGFPPVACRRRRSAGSAGRGSSAHGRGTAAAACRWGRNSRGIRPSGLPARFRRG

SEQ ID NO: 32317 - protein, 153 aa, Pseudomonas aeruginosa
CRCAGWEWSDPPGCCGPPASAGPPTSCPNCRPASVPRGNRRCRNSARRPAHGARGPGSGSGPPARRARRFPAPARAPAGAARSVPRASRRAAWPRCPAARCVPAGRNAAPGANGRGPCRRAGRPARPVPARRAGCRGCCGTAGRVRGVRRPGG

SEQ ID NO: 32318 - protein, 149 aa, Pseudomonas aeruginosa; identical to SEQ ID NO: 27817

SEQ ID NO: 32319 - protein, 241 aa, Pseudomonas aeruginosa
  UNSURE (126): Identity of amino acid at the above locations are unknown.
RMDRSLFLAGGSSPIRWRSEPHVTLAQPLPKVLARCLFREVADIFGSTENRSHRCTTGVPVNSPCDRRAPVVGAGGAGDFVGPGDLAVGEVHVFQVGEVGVARVLAVVHVVLDVDDDRVFQDGGVXVLLGAGGGGAVPLDLDLGQALAGGQGGQQQRRGLVEDLGDDHRLVHALAGRLAGLRVARDDHFVVEALDHHLVLVAFLVGVADRILGEGAGGDQALLGAGDGHIGGGCHGYVPCR

SEQ ID NO: 32320 - protein, 197 aa, Pseudomonas aeruginosa
RRMRPCGVGLVEGMPDFGAAAAFSVVAVFFVYNSSKDNLYCFASGSLAGCKRAAPGRSRSDPHRTKARGGVVSASGRPQPMGRLTTHVLDSAHGCPGHGIKIELYRVEGQQLELIATTLTNHDGRCDQPVLQGEDFRPGVYQLVFNAGDYYRARGVQLPEPAFLDQVVLRFGIASADDHYHVPLLISPYSYSTYRGS

SEQ ID NO: 32321 - protein, 585 aa, Pseudomonas aeruginosa
PRAAIRHPGGSEEDELGDEDHEQRIEAGRDFAVLAGEDLHRDVGDEAQGDTVGHREGQRHHDHRDDRRDGLGVLVPVDVRHSAHHQHGHVDQRAGGGEGGDHPGQRGEEHRGDEQHADHHRGEPGTSAGGHARGALHVTGHRRDTEHAAEHAGGAVGLHRFRQVLDAPVLLHQVRALGDAHESAGGIEHVHEEEGQDHADHGDVERAGDVHRQEGRRQARRRREHPAVLHQAEGPADQGDAEDADEDAAEHPAVLEHGDHQEAQCRQQRAGRGEVAELDQGRRAGHHDAGGLQADQAEEQADSRTHGEPEAAGDAVEQPFADPGEGQQHEHHPGDEHRAQGDLPAVAHGADHGVGEEGVQSHSRRQAHRPVGVQAHQEAAEGGCQARGDERRAVVDAGVGHDVGIDEDDVGHGDEGGQPGRQLGPDRRTMLAELEQAFEQAGGGRCRSVDPLFFLFGAFHSRYSSSLLLLGPAGRLVTRSLTRLEGDVRARFSDLWVKNSCERLCLCIQKGQRMFEGVSPHFYQLSVTPPSGRCRALGTRGGKGWCVGCRCLCTLFRYQPPACLTHARERGSAQATSRTHKVRDR

SEQ ID NO: 32322 - protein, 148 aa, Pseudomonas aeruginosa
RKPRGPRPPASALRWGSASSNRRSCRRLRWALPRKSASPGRNAPGRRCAACLAGDAARRPARRRNRRCGAGGCRGRNGACAGPRPRRAPAPGLRTRRSPPWPPCARFPGCRRRPPGPSVRHTPPCHRPAAGRRPPPGRCRAGRERRRR

SEQ ID NO: 32323 - protein, 421 aa, Pseudomonas aeruginosa
KKLTFESNNFLTCRSVSLPINENGTRRCRFPGAGRSDALGVGKLVFLAGIVGAHLRVHHRAPERREQGEDDHPGVAVGQLRAAVVVAQHLVAALGVGMVVGMALQVEKEQVGQEEIAVPRVFRRGAFVAAVVQAPPMQAVVLDVVDDLQQGEGHHRLAEEEDRSQPAEGQAEAEQEEGADGVPPDQLVAPVQGRQALALQALGLQAPGVEEVVLVGVREERVEALAVARGRGIFRGRDVYMVAAHVFDLEAGIAHRCQQQAAGVLFQLRVLVDQFVGDGDADGAHHGAHRQDPAQLADPVPAGLVGEDPAGPDEHAQQQRDGGQGQYAVVALCFHLRHFAGFLGVGRIAADDGIEDRDQPEHHADHQPGPGVGVVATERPPVAERDAEHRDQPDPVAVLFQTQHPGRGKRGKHGKSSYLSC

SEQ ID NO: 32324 - protein, 267 aa, Pseudomonas aeruginosa
QLSSLDRPAPSQPSFCPPLRREAGGVTPCVTLPIHIPPENAPLDKRITMTFKAPDSLAEQIAHHLAERIIRGELKERERIQEQKVTQTLNVSRGSVREALLILERRHLVNILPRRGAQVSELSPQHVESLYALIVQLYILLAESVARRWRSEAELAPFLVIQQRLLNNLAQSDIDGFVEASFDIMRAAFPFANNPYLQETVENLLPAVSRAYHLALERRKAEMNQFLGSFAQLLQAVIARDEARIREVLLEYGRHNCQLVLAALAER

SEQ ID NO: 32325 - protein, 345 aa, Pseudomonas aeruginosa
WRPWRERTHAPEEHQAGGVQVLRRSDHGELPQQHGGSGRAERLRQVEHHRRGALGDGRKLGEEPARRVDDRCHLQRLEYPQAGEPGEHRADLRQRRDHTGGRIRPVRRDIHSPAGLAGWAEHLFPQRHQVPAARHHRHLPRHRPGAAQLLDHRTGHDLQADRGASGRPAQLHRGSRGHFQVQGAPPRNRKPHPSDPGKPGTPHRPARRAGAATGTPAPAGPVGGKIPGAQGRGAPAQSPAGRRALARPERAGRSARAGHRRPGDRLRGPGGRAARCRCRHRTAARRPSRVVRTLQPGAGTLLFGRRRHRPGRAEHPAWPAAPAPVAGRLARSRTDPPGNRIAPRA

SEQ ID NO: 32326 - protein, 421 aa, Pseudomonas aeruginosa
PYLARDPGRGNGHARTGTGTQRGRRGRSGHRPGTGRAGHAGLAAAVGCLQPAERRTPPPGRGAAVAHPAPGAEPGAPAGSRAAPAGGAWPVGGRPRGRGDPRTQRTGGDRRTGPGRTAIAGAGPSRATRTIAPGIAAAGRRTAPGAGRVAAPERAHRFAGGPAAGRSRSRTGRLGVVARAGPGTTSAPRRRLACRAGLGAGGGDRARRGSAGGLAGRLRRARPGRLRQGRAAPAQPRSRSRDGGRFAAGQGPRRRRPESLVGPGETGGDPGTGARPARRPGRRREPDQSRWLLGRPALPAGPAQRRGPGRHDRPRPGTGGVAGAAGAPGNPCLRRRGASGCGPRRAARAGRRARAGAAPGPGGGAPARRAEGAVVRAAGQGRATGTASPPSRRRSGGTGRAARAGTGATERGAPDPAGSAG

SEQ ID NO: 32327 - protein, 365 aa, Pseudomonas aeruginosa
RPARTARPDSPGCPHPQGPCAPVGGAGRLAEGAAQFHPAGPGAPRPAVGAPQRALRTAQPQSGGGGGTAGRAAHEARGVAGAADGRRGRTQAGAAGPGRRRSRTARGGEAPRPGRAAIATAAWPAGAAAPGVAGAGGAAQSLAGAARRRRLRPAYGTGQPAPGCQRTRLGGASRESRGAHPASGADQPGGDRGVPAAVRAQALPGLAERRPGRSAGDAGKRHPQDRPGNPQSFQGNLRPDQCWPSGIVPEGIRRRYGISGTYRRRSTRYRCGDHGAPAGQEEQHHPLVVRRGKGADRAGAGIRHLPVEPGAVLHARRSRCAIGRCQRRTLCAIGEGDVGKGAVHLYHPQQDRHGNGRSVDGRDHA

SEQ ID NO: 32328 - protein, 294 aa, Pseudomonas aeruginosa
GLRNYMDIGLREWLIVIGLIVIAGILLDGWRRMRGGKGKLKFKLDRSFANLPDDDGDSAELLGPARVVEHREPSFDEQDLPSVSAREAKERKGGKRQEEPRQGDLDLDEGLALEADPSDAAETVEPRKGKSKGRKEKEREKAPAVAAEPAPVDEVLIINVIARDESGFKGPALLQNILESGLRFGDMDIFHRHESMAGNGEILFSMANAVKPGTFDLDDIDNFSTRAVSFFLGLPGPRHPKQAFDVMVAAARKLAHELNGELKDEQRSVLTAQTIEHYRQRIIDHERRSLMQKR

SEQ ID NO: 32329 - protein, 824 aa, Pseudomonas aeruginosa
SGHSPFLRTGGGELLYRAAEAALFVSRTPTMTDTQAAAERIAQLRTELDTHNYRYYVLDEPSIPDAEYDRLFRELQALEAEYPQLLTPDSPTQRVSGTPASAFGEVRHEIPMLSLGNAFEEQDLLDFDRRVREGLADLLPGGDLLGGGAEVEYSCEPKLDGLAVSLLYERGQLVRGATRGDGSTGEDITSNVRTIRNVPLKLHGEGWPEILEVRGEVFMSKAGFEALNAKAVETGGKTFANPRNAAAGSLRQLDSKITASRPLEFCAYGFGQVSGSLPDTQVGILEAFRGWGIPISRELRLVKGAQACRDYYDDIGRRRDALAYEIDGVVFKVNRIAFQRELGFRAREPRWAIAHKFPAREELTELLGVEFQVGRTGAVTPVARLKPVQVAGVTVSNATLHNMDEVARLGLRIGDTVVIRRAGDVIPQVMQVVLERRPADAQAIEVPEHCPVCGSAVERTQLVKRSKGKESISEGAIYRCVGRLSCQAQLKQAIIHFVSRRAMDIDGLGDKIVEQLVDRGLVASPADLYTLTYEQVFELEGFAELSTNNLLAAIADSRKPSLARFIFALGIPDVGEETAKLLARSLGSLERIGKALPEVLTYLPDVGAEVAYEIHNFFADEHNRQVIAQLRDAEHGVQLQEEGEVAAEFAACASLAGFIDKLNIPFIAATGAEKLASRFGSLDGIIRADWLDLRQVERLPERAAKSLRDFFDEPANVQRALAIEAQLREFGMHWQSERKAVEGLPLAGQTWVLTGTLEAMSRDVAKDKLEGLGAKVAGSVSAKTHCVVAGPGAGSKLAKANELGVKVLDEDGLLKLFDEHGVAR

SEQ ID NO: 32330 - protein, 140 aa, Pseudomonas aeruginosa
SGGAAAKDFRRLELTMDKARKQRLLGVLALVVLFGAYVGWSERPRILLHYSGQASAPIAYSYKEQGVETFSGEIRPGQVREFPVKLFGGSDYRIAFSFHRGEEKYASFSTKPGWGTLDLYVDTELSVSTQPPPEGLIQQQ

SEQ ID NO: 32331 - protein, 125 aa, Pseudomonas aeruginosa
MIQSGPVTSASVQSSLREGSPMNEKLFVLASQKKTTNHILHLLLCIPTFGLWLIVWLVVASGNSRHNARIQAQMNHILGYKMQGMSDVETYQRVSSDEAARKKRSDQIFVVSVIVVTVALFFLLK

SEQ ID NO: 32332 - protein, 366 aa, Pseudomonas aeruginosa
  UNSURE (289): Identity of amino acid at the above locations are unknown.
RGVTPDVQATPDNAISEVICTNLDYAQYSCAPKRGVSMASDTSLIAEQGVATLPDAAWAQARQRAEIIGPLAALDVVGHEAADAAAHALGLSRRQVYVLIRRARQGAGLVTDLARSRSGGGKGKGRLPESVERIIRELLQKRFLTKQKRSLAAFHREVAQACKAQKLRAPARNTVALRIAGLDPLKATRRREGQDASRSLQGVGGEPPAVTAPLEQVQIDHTVIDLIVVDERDRQPIGRPYLTIAIDVFTRCVLGMVVTLEAPSSVSVGLCLVHVACDKRPWLEGLNIXMEWPMSGKPKLLYLDNAAEFKSEALLRCCEQHGIRLDYRPLGQPHYGGILERIIGTAMQMIHDHLPLDNLLPPLDHR

SEQ ID NO: 32333 - protein, 201 aa, Pseudomonas aeruginosa
LLFRAPVRMATAPFALTRPARLLSKPVLFRVAPASVTNLPPWLFNSPRLVTSRLPALEKVPAWLLTWSAFTVSDPSLTSAPLPWLSNAPLSVTSTRRWLLSRPPSPLSSSAPSRCNPSRLASTPLAWFSRRCTVRLSSLSPITLPPRLSSCSRTARATLATLDISPPRLSIWRASAVTPPSALTRPPLRLSRLSASRVSVP

SEQ ID NO: 32334 - protein, 650 aa, Pseudomonas aeruginosa
LHRQEAPAVQAAGLVIERTGQGDVDTLLAGQQAPRAVEQLRSTQAQPIAAGEYPLVLVEHAWRCDVQATVTDDLATAVVQLFASARHHPRRAGDIARSVVDQPRAQVEILAGDNATAAIIEPIRLQERTALADQLAARTVVQTSDLDVHVSLAGKETGTAIVQCGSLDLQFVQTDDLAATVVEIATSLDHGAVPALQQAVLAVVQAARLDPQFALGEQLAATVVQVSAVDPDGRPLQAAALVVQCQARLRFQRAAGHQAAGVAQGAAAQLEVAARVAPLVWLDAGFDHPGVVDMRRLQRDAFARRQALPVDQFLRAADLGAATGVGLAVQLHGLGRDLQVALAGGLGQAQLAAGVDADVAAAGGHVAGQPHPHALFGADQADRPGVHPAQRRAVDRQLWLLAAIGGARRGLQAVGLDVVAAGDDVEVLRVELGVELGAAGDQVELFEVADVQFGAFDDDVAAVHLEALQALAVHDRLAGGEGRARRVDEAAALAGDAVRVGDDHPRRLPGHLGVAGQGAAVAAGDLVEDHLRRLALEVGVAEDDPAELGTLGLAGGVVEDQPVGADVVVAEMVVRQPGAVGRGDIDDGHAVARLAQAGVAAGGLVQRQPRRRGDDRVEEQDAGQGQGDALVQRAADVHIVTPWRVGARRG

SEQ ID NO: 32335 - protein, 207 aa, Pseudomonas aeruginosa
PSLSITSSAPVWVRLIRRTVASLSFLKPRVTASCWSRGSVLSTSTWPISAKPALSETTLAPSAPWADWRPLVMPSLTPPRRFLPVSMAEDTAALAASLTELPSSAATALPAARGRSSPNAAILAFIRPSSGGVGGSQTNSRLAAVPVARPALAPPDVDTGQRQPGDGQAEGGDGDASRQAGDAPAVDRVLQAVETLSPTALPGDFLA

SEQ ID NO: 32336 - protein, 937 aa, Pseudomonas aeruginosa
PGYGRRRRRMPGAYVARRAAWPVPRRWRRGPGGRSELVVHRRGDVALLAEVAEVQAVAGRHVVLVQQVVGIEADVQAFQAELAEVVADPRVDQGVVRHPQGVFLVRPGLADVASAAADAQTAERAGVEGIVGPQRSHVLGRLVRRMALVAVQRLGVGDVGVGVAAEQFQVVAELGMGLQFEPLGAHFADRGVEVVLGFLGGDVFLGDMEQRGGVEAVAARRLELQAEFPLLALGGRQGRAGGVGIGVRVERLGVADVGRQAVVEQVQRADPPGEFLPVIVGLAAGAAVLVGDADPVLAQAEREAPLVDVDQVLEVDAGLLQAAGVVVVREIADGVVAVDRVERVQRRGRAGTPVDHGAPALVVEAGEQGVARRAGGEFGLQHVVDDIRLQVLAGAAEVAVQLVRLAGAPAVGVDLRQVDVGVQVAEVLPRRPDVVDAVLQLVAEHPLGAVEVVLARLAIEELAGDVPAVVVRQGAVGRYAAVVAPVGIVLQVALQGQGGVVAEVDGQGRGDGVALLLDVIELGVRALAETDQAVGDALLLVERPAEIEAHLLLAHVADAAGDLAVVLVQRLLAGQRHQAARQATAVEHRGRPLEHIDAFEEVRVDLHRAEGTAVAHGLEAVEVDVVHAVVGEAAHHHVVVAVGGADLAGEDAGGIAHRLLHGLGGGVVDLLAGDHRDGLAGFQQRLAGLGGDLAMGGQVAIGAAQVVAEGEDLHRLHVQHIAVLCRRLAQDEAAVALVFRFQRGVGEQPGQALLHGETAAQPLGAVATGLRRSGREGDAGFAGEAVEHVAQLSGGDRIGPRVFRRRFGGRGAERRRAGRHGQRQQGRAHRTAQARGAGEIEGRRGIAEDDGGGGHERDPLESLKGVQSVKPDQSRKADKNNENNFQCVSLRTKASVHAAAGATQAATTLTHQRVCRCRRTGRVRASTCSSLSVSSRR

SEQ ID NO: 32337 - protein, 375 aa, Pseudomonas aeruginosa
LSDRGGPASSRRRFIGMHNDNSTEKRADFYRRIRQQHLTPLWEALHSLVPAQPAGGCQAALWRYRELRPFLLEAGDLISAEEAVRRVLVLENPDLPGQSAITPSLYAGLQLILPGEIAPSHRHTQSALRFVVEGYGAYTSVDGERTPHGAGRLHHHPVLDMARPRQPAPPRKAASRWSGWTAWTSRCCVSSAPPSPKTMMNRYSRCDVAKATASPATAATCCRCAISRRRRLRRCSATRTRAAARPSSAWRASNGPIPGKATSCATSTRPPAAGPCRPSPPACNCCRPASSGSPRAAPTPASIRWWKAAAWRRSAAGASPSRPRICSSCPPGPSCAWKPAPPTACCSVSPTALCSRRSASSANPAKPSPTEGPVP

SEQ ID NO: 32338 - protein, 833 aa, Pseudomonas aeruginosa
TDTVAAPSSPAPQRASSSAAWYRNWPTPGAWAVSWRPTRRCSNWRGAAWRSKPSSAPAPSASPTTSRTDALPRGKQQQEGHAHDHPHPDQPAGPAPAAALVPGYRRAAGDEPRPDLLPRRQGPARHAVPAVREYLRGRRLHGRQRSPAPARQPPAHPARHQPLRPHQPAPAVRRLLRRGNPRPGVARRSRLRTPRRQRQRPRQPDRQSVHPAMAADRAVRPALLAAPEPRLPVTHRALRQASGDQSRQQPLELQPALRADLGIRRRLGSQRSPAVPVAGQESRPGAAVGRRLPATGPGVPRQLLGIAGAGCALASRVVRLQPATDHRRAGRRARPPGLPRAGRCHRPGADVRLGQVAAVPQRLSRIRRTQPQRGQPADPALLAGLLSVAFRDDRQALQGAEHRAAPPAQVRRFRGQGETATHQAAQCALQFEPGQVRAQAVVRTMGERHVLLGVRSLQLQAVGGGEHLRVAVRREEAQPDLLSRRNPLAADLHLLQGATHAAAHRAIEAQQFLHRVRRQLRAPPQQVELVGMGEQRQRSVADHADGGFEGGHEHHGIGRYQVLEAQSGLQHRGAVEDARRRAGRRARRAIAPAARLALQVVAEGGRAAVDLPGIAVAGGEIEPGGQIAAPGQQLPGIFAGKAEQLGGHPDRQRFGEIPEQIGLAALQQAVEEFLHQHLDARFPAAHGVGAEGRSEQPAQAGVPRRVVEQHEVVVEARQRLQLLVAEPAGAALADAGGAKASGVGGETAVAQARRNIGIATDPPDRGLVAADRRTGADQPQQRIGIGDEVGMVGVDVETVAPRGQRRTLSVMARLRAAFLAECVVHGPCSAGLA

SEQ ID NO: 32339 - protein, 184 aa, Pseudomonas aeruginosa
TAPARRCARHRAPPANRRAARRRGRGTAAGVAARPPAAPGKNSASAALPGRLPMGEEAAGVDFAGQPARAALLAFRADPDQARRAGYLVAVQQLAAGGVVRGHVEPQQAHALQGGEHIGLGEHLFLHDPAGHAPVSVVVEQHPLSLGLGRSQLTVQLGRLAHREERLVGAGRRRSAPVRRRIHL

SEQ ID NO: 32340 - protein, 165 aa, Pseudomonas aeruginosa
RTPGVVGPGRGAQQHRRAPETEDAARRAEQHRVPRQASRRVQRGVGQDQQQRAAKADPQRLAEQRTQEYPGGAEEKEAEHALDQVHPGTGLGQEAAADRHQQQQRHADAEAQAEQHQAAMQGIAGLRDIEQGPRPAARSCTAPPAARTTRRARPRRPGCRPCGRD

SEQ ID NO: 32341 - protein, 237 aa, Pseudomonas aeruginosa
DRRGGRAGQPAVAVRRSRTSAARGTRTARRSCPAATAVAARPAGCRQAAPRPPRVRRRPAPCSARSYRPAAGRDEGRRRCRPPARRGSAASAANRERTPAAGRGRRTATGSRPGCRPAGCRPGPGPRRLRRSSRRRQGRYRPGRAPGSAADSTGRHRRSPASPGAVVRRRPPAGSVPGSGDRPATRRRTRRCGFRRAAAAAARPGRVRRSAGASGTGSSPARSASAVAPGRRRGAPR

SEQ ID NO: 32342 - protein, 684 aa, Pseudomonas aeruginosa
SWLNSPASDSYPFNQRYRHACTAHRRRRPDRQRHRRRPQRPGPDRGPGGQRRRYPGAAPGGALRRAGPRSRPARRGRPAPAATPAPAGRRPAGAGADRARRGDRPGRRAAGRRRRLPAQALRPARTRRPPAYLAAALRRALRQRHRTRPPQLRSEHPRNLARRPPRGTVATRTGAVAGIAQQPRADPQRRAAQGQRLWLRRRGREQRPQRPHPSPAAQARQRHRADRARPRLPPRAGARRRRRRMSLRLRLTLILGSAFILLWSLAAAWMLCDLRGQMMRSFDQRLAASARMVAGLLQQLPQPQPADGQTTRLSAEQLGIPNGMACQVSSLRGEVLAQSHATPERALDSTASGFRDQEINGVLWRSFTVQAGDLRVSTADRLEERDVLQRSVVVAAAVPVTVALLGSLALLWLGAGQGLAPLKRIRDALTRRGADSLEPLELAALPSELKPLVETQNQLFQRIAQAIERERRLTGDAAHELRSPLTAIKTHLQVARMTEGAAAEQALAHAEEGADRLHRTLDQLLLLARVEGSLSFDDGVQCSAEDAARVAMHDAGHGDVRMFELKLADGLSEAPLEVPSVLAIAALRNLLDNAVRHTAAGTRVELAVETAQGCARFHVRDHGPGIAETDLPHLTRRFWRHGKSGGSGLGLAIVQAIVQRCQCRLDFDSRADGLRVTLEMPLRE

SEQ ID NO: 32343 - protein, 133 aa, Pseudomonas aeruginosa
TGSNRVARSAPGYPRPAPPAGSAGNGAGRAAFPARRPARGSRRRCPGGRDARRAWSPGRRRGRGQGRGRCGPGRASPGCRSFPPPPAAHGSAASPHPSRRGSARCRRRYGRSAARWRSWRCHPCCGARPARNG

SEQ ID NO: 32344 - protein, 88 aa, Pseudomonas aeruginosa
PLLARFRPARPHRPARRNEPKEASMLSARSRKAPTYGVTYVSLEDCTLHFETEYIIERRDGSLAHMPMRTPVSEREALQRLIESCIDD

SEQ ID NO: 32345 - protein, 294 aa, Pseudomonas aeruginosa
PEPSAPRAFPHEPRQYAPRLGSTRPATRCGGTHRGLLRRPRLRSASPRHLCHRPDPGRGAELPLSPQPAPQPAGRLPGAASRRAARRRGRQPGRVPLPDALRRAGADPAGPRRPAAAVRARGLVRRPAPDRRQPDPATGHGYPAGAAGRTGRPVRTGPRPRRRGRQPGARQAPLRLRRRRARPAVHPRAPGAPAGPRRTGAGRPARTLEPVARFPRAVRHQPLPLPDPAPAGHRPPADARRPDAGRSRACRRFHRPEPHDPPFRPELRPATGTLAAYARPRLARLHDHPRPPAP

SEQ ID NO: 32346 - protein, 174 aa, Pseudomonas aeruginosa
KTNATPPQPAGNIKLSEHNFSKLKIDKIRRSPTLIISGYGAGIAILFSIFNDQLGMEKKWLATIDATLSICAIIFYTGIIHLISTTKALKELNKEKSNQLEPRKRIQTLSGLLIMISTGLFGLYLIGNSDISPGAKLSSSTTGLILLSSCIIALLITFEKISKELSGARTKSPP

SEQ ID NO: 32347 - protein, 383 aa, Pseudomonas aeruginosa
ASTPSAAGSGTGRCATPPRSRSSKLFQRQDERRSVWLGLLVEQINAGLRTQKLQLFYQQLNGLLFGVENLLVIWLGATMVMDGQFSVGILMAFNAYKSQFDSRVGSLIDKFFELRMLQLQGERLADIVLQAPEVSHGDILPENLREREASIEIQGLRYRYAEQEPWVLDGLDLRIAGGESVAIVGPSGCGKSTLLNVLLGILPPVEGQIRMAGLDLAQLGLDGLRELVGTVLQDDVLFAGSLSDNISFFDPQPDMPWLLQCAQMAAIHDDIQAMPMGYNTLVGDMGTVLSGGQKQRVMLARALYKKPRILFLDEATSHLDVHCEQRVNAAIRALRITRIMVAHRPETIASADRVIVLGQGKVSLDESTARLAERQAVAAREQA

SEQ ID NO: 32348 - protein, 371 aa, Pseudomonas aeruginosa
PPTPAPRTSTSAPSATGRPRACDWRRASVAWVSGACAEKPGKRRRSLPLALVRLAAIAQDAPSPRDERPHDRRHPLPDRIRQDRRDRLRLRRRRGAGPERRDRQPAPVQAGTEPGPCAALPQQPQAVADPGRHAVAGHRPLHAGTLREGLHRVPPARRLDPQQPAHLDARGVCLRRLHPSPGSLHRGASRPRPRHRMRRQPPRHHRRRHRHRLPHRRPAGQLAEGPSPVPAAAPGSGGTGIPGPARAAGTPARPAAAGMDRARHAPRQPAIPSCAGRRGGTRRLHPAGARRQRRSLLPPGPPRRRPGRAADLPERRADPPRRVARGAAGMAPGAVEGVCGVAAQRTRQQHRLYPHQSPLRGLQSGLAASCR

SEQ ID NO: 32349 - protein, 506 aa, Pseudomonas aeruginosa
RSSRKPPAATSAARSRWVAQITWISTACRRAAPSGATSPSASTRSRRVCRPSGISPILVEEQGTAIGLLQQAAHPFRRRAGKGSANVAEQLALDQAFGNRRAVERDEGFVATGAGLVHLAGENLLAGAGLALDQHRQVAVLDPHRQAQAFGDARVERSVVGHLALQPPRLGPRRAETHVQLAGLAAQQARRLVGGGVQGVEVEHLADVARHLPQALPQVVPRRRVQRQQAPIGVPGEQVVRLAVDVARRTVRAQHPMALGAVHEEGVLDLPRALRHHLPDQMLATAVVRRLHGGNVEHTEQLALRIEDRRRGTGQVDEGGAEVIALVHRHRSPVGEYGGHPAGALLAFRPAGAEVQPGLAAVVADGRLDTVVDGPPLGIGEQYAVVGIAHPSMQSRHLFAGDAQEQFGTLATFVEEGLRENPRPLQGPRVETVLLHGAAPGVEDRRRHRRLRQARGVPQDTADTVHMVLRVCGKHGASVARHLVVVPPIKRPSATLDKRRAATADD

SEQ ID NO: 32350 - protein, 690 aa, Pseudomonas aeruginosa
DGASQRLAGNPCAMTWVVSPDVAPAVAGLPMPALYDGPSGRHAATWHRPCSSHGDGRADCPLLPTPCRIHLQEQSEVKHARYVVRRFLPVFPGRAGDRRRTRHRPGHRPRPGARRRRRGGGRPRSAGRRGNRRRDPQPRSPQPGPWGRRQRRRQRPGDGRAGRHGVRPARRGGEQCRGDQHPQGRRTQPRRLGPGDERQRPRRVPLLPGRTAADAGAALGADRQPVIDRRQGRSPRPRPLLCLEVCRDRFQQCPGQGGRARRGDGQRALPGNRRHRNVARRGRLVGPLAAGRRKRGAVLGTPPGQPAAPGRGADRRRHGPARRLPGLRAARHRPGHRRRRRILAMTPPSPIVGIIANPASGRDLRRLTAHAGLHSSTDKASVVQRLLAAFGATGIRHALLPPDMTGIAAAVLRASQTRQARDGHWPFLEFLDMPLRQSVEDTRLAARRMVERGVALIAVLGGDGTHKAVAAEVGDVPLLALSTGTNNAFPELREATGAGLAGGLCASNRVPPEIGLRRNKRLLVREPRRGLCEWALVDVAVSPQPFIGARAISRAEDLAEVFVSFAEPHAIGLSALCGLWSPVSREEPHGAWMRLHPDARESLLVPLAPGLLVGCGVSAAGYLQPGVAHAPSLSSGTLALDGEREIEFSATDRPSITLDPSGPFSVDVPATLAYAARHRLLAGQRTPMTP

SEQ ID NO: 32351 - protein, 240 aa, Pseudomonas aeruginosa
RQPGEQQDVHSEHRPTAPCLPRDAHHPRLRGTPARRVRHGRDTRLRPPLRRRGSLRRRRDGAPARRRLHRLHPSRPRPLHRQGRRRARHDGGNLWQEDRGLPGQGRLHAYRRPGERHARRQRNRRRRRAAGRRRRAGGQAERQRCGGGGLLRRWRLQRRRGVRGDEPGRGVEPAVPVRRREQRLCRGHRGLLVGGLRPHRRPRRRFRHARGDRRRLRTSSPSTRLPAPPSSAPAPARGRR

SEQ ID NO: 32352 - protein, 786 aa, Pseudomonas aeruginosa
STTGKPATASSSSANAPATPACSPPATWTPSTPRSRRASRMPCSARRTIPSRSRTTCCATSTCPIPEPPENKNEENHHGEKDQLPAGHQRGAGPGNAPRPERLHHGRRQCRRRRRARRGRRLGRRAGGHQGPLPPVPRPCAGYPVVRDRLCRRRGRRRHPRHAPGVRTDVRRLRRLLPGPDPQPGRQVPLHVRRQGGHPAGDPYHGRRRPARRRPAFADAHFAMDPHPRPQGSLPVVALRRQGPAGPGDPRQRPGDLLRAQAALFDAGRGTRGAVQRTLRRGELPPRRRRRHPGDLRPHGPPGAGRRRQPGAPGHLLRSTGPAQHQPAGRGQHSRKRGKDRPPGGGRRSQPTLLDGHRHRRAGRRTGLLRAARADPPGHRAPYAGAFLRRPGRPLHPRRGEYRGSRAPGPGREGRGMSRIHTLTMPKWGLSMTEGRVDAWLKEEGAHIEKGDEVLDVETDKISSSVEAPFSGVLRRKVAREDETLAVGALLGVVVEGEASDEEIDALVQRFQAEFVPADEDAGDSGPAPRKVELDGRLLRYFDRGEGDPALLLIHGFGGDLNNWLFNHEALAAERRVIALDLPGHGESGKALVRGDLDELSGSVLALLDHLDLEQVHLAGHSMGGAVALNCARLAPQRVLSLSLIGSAGLGEEINGDYLRGFVEAANRNALKPQLVQLFSDPALVTRQMLEDMLRYKRLEGVDAALRQLLDNLFADGRQRNDLRAVASEGRQPVLAIWGSDDAIIPARHAEGLPAQVEIIPGQAHMVQMEAAEQVNRLLLDFLRQH

SEQ ID NO: 32353 - protein, 292 aa, Pseudomonas aeruginosa
GDDRHEQFPASQRGDARRRLARPPRYPRGRRAAPGRAAARLGADPRALVRHLRLRPARIPGRPGIHPRGGAAPAHRPQGSMHPRPRVQRRNRPPRQRRDRLRRRPGGRRRRLPALRHLLLLPAWAVQHLREPGLHRADEQRRLRRIRQRTGQPALRPAGRISQRGRRADRAAGGGHARGEEGRQPARAERGGGRRRHHRPEHHHVRARRRRGTGDRPGDVLGAQGQGPGGRRQPGARPLAVRRPRRNPRPHRRAWRRRQLRMHRQQAHRQAGHRCHPQGRQMRACGNLRGAQ

SEQ ID NO: 32354 - protein, 203 aa, Pseudomonas aeruginosa
DQPGEQAGAGDAAAVDHVAHQHLLVLVAQLRLHRTQVGAGLAELGVQVAARRLQFVDQLLARVEGFLHALHAGLPGVVDAVQLGGQGGYLLFQLRQALGLAGNLLQVAAGNPHGAAVLAAHLAVVALGAKQLDLLPGGEGADDAIAIGGAAAHESGQAVAHPARVAGRLLGLRRGAGRQQAAEQAGSDDAVLERGKSGGDATG

SEQ ID NO: 32355 - protein, 143 aa, Pseudomonas aeruginosa
TTSAPRVGGDPARHQQRRAADRVGDDQRAQAEHLLHQTLGEDMRRRALGEDRAVTHGDQVRGIAAGLVEVVQHGDDGAPLAIQLGEQFEQFDLVDDIQVGGRLVEQQQRGFLRQHHGDPHALPLAAGERIERSLGQAVDPRGA

SEQ ID NO: 32356 - protein, 143 aa, Pseudomonas aeruginosa
RRRYRALIRRRPLAQERLVRIAPARHQLGHRDAIRRQRALRQQAETPRHFPSRQAVDIPAVQHHPALGRRQQARQCRQQGRLAAGVGPDDHTERTLGDGQREIPRNGPRVAAQGHGVRVQAMGHGRFLDKNGSNMWNRLYIME

SEQ ID NO: 32357 - protein, 318 aa, Pseudomonas aeruginosa
EALSYESVRPASPTAKTAFMPTRRRSALPLLALSLFATLAAAGEPKPARIVSTTPSVTGILLAMDAPLVASAATTPSRLTDAKGFFSQWAKVADQRGVEVLYRNLRFDIEAVIAQDPDLLVASATGADSAAPYRAELEAQGVPTLVVDYSKHSWQELATELGRHTGLERQAQAAIQRFDAYTAEVAAAIAPPQGPVSVVGYNIAGSYSIGRQASPQARLLEALGFQVAELPEALAGKVTRASDFQFISRENLPAAIAGDSVFLLGASDDDVQAFLADPVLANLSAVREKRVYALGPSSFRIDYYSGRQMIDNVARHFR

SEQ ID NO: 32358 - protein, 350 aa, Pseudomonas aeruginosa
AMRPFAGSPLMQASPMRRRRLRAWGLLAGALLLALAALASLALGSRPVPLAVTLDALQAVDPHDDRHLVVRELRLPRTLVALLAGAALGVAGALMQALTRNPLAEPGLLGINAGAALAVIVGVALFDLASMGQYLGCAFLGAGLAGIAVFLLGQARETGTNPVRLVLAGAGLSVMLASLTGIIVLNAPPEVFDRFRHWAAGSLSGSGFALLGWPGLAIGAGLAAAFALAARLNALALGQEIGRALGVDLRLTWLLACLAVMLLAGAATALAGPIAFVGLVAPHLARLLAGPDQRWILPFSALIAAGLLLGADILGRLLAAPAEIAAGIVALLLGGPAFIVLVRRFRLSRL

SEQ ID NO: 32359 - protein, 173 aa, Pseudomonas aeruginosa
TVSTPCAWAPCRCVGGHGRRWPAWSSRGSDWRWRRRCWGPAAWRWARQRCSPACSARARTPPPSASSSAYACHGCSPPAWSAPRWAWPGRSSSRSRAIRWARPTSSVSPPAPPAAPSCRSSCSMPARWPPRWRRWPPASARRWRWCCWRAGAPPPAATAWCWWASVSAPACRA

SEQ ID NO: 32360 - protein, 109 aa, Pseudomonas aeruginosa
CAAAGFEPRPQRPPRLPPPSTPITWPVTNEAPSLSRNSISAATSSGRPSRCMGMVERIRRSSSPPTGRVWRNSSVSIGPGATALTVMPSGASSSAQVRVTPTSALFAAA

SEQ ID NO: 32361 - protein, 581 aa, Pseudomonas aeruginosa
RSPRLHSPGGDSMIEVTEVSIAELRDALESGRTTAVELVQAYLARIDAYDAPGTPTALNAVVVRNPDALAEAQASDARRARGEPLGPLDGIPYTAKDSYLVKGLTAASGSPAFKDLVAQRDAFTVERLRAAGAICLGKTNMPPMANGGMQRGVYGRAESPYNAAYLTAPFASGSSNGAGTATAASFAAFGLAEETWSSGRGPASNNGLCAYTPSRGVISVRGNWPLTPTMDVVVPYARSMADLLEILDVVVADDPDTRGDLWRMQPWVPIPKASEVRPASYPALAAGAEALAGKRFGVPRMFINADPDAGTSESPGIGGPTGQRIHTRPSVIALWEQARKALEAAGAEVIEVDFPLVSNCEGDRPGAPTVFNRGLVSKEFLHDELWELSAWGFDDFLRANGDPKLNRLADVDGPQIFPHDPGTLPNREGDLAAGMDEYVRMAERGIKPWDRIATLPDGLRGLEETRRIDLEEWMRRLRLDAVLFPTVADVGPADADVNPASADIAWSNGVWVANGNLAIRHLGVPTVTVPMGVMADIGMPVGLTFAGRAYDDSALLRFAAAFESTGSRRIVPPRTPPLASK

SEQ ID NO: 32362 - protein, 188 aa, Pseudomonas aeruginosa
LVGYGKPLGGYKNSRVKTLGPGLRRIAPSSQRRKHWMQSLHTLVSVRPVAHEDFEQWLEYWKAYQAFYEVELSAQATEATWRRFFDEGEPMHCAVASDGSRLHGIVNFLYHRSTWAAQDVCYLEDLYVSPDVRGQQIGKQLIEYVRRQAEERRCARLYWHTQESNHRAQRLYDWVADKPGVIEYRIEL

SEQ ID NO: 32363 - protein, 159 aa, Pseudomonas aeruginosa
TGRATGASAAPLMHRGGPSTRFSVPGRRQALRTDLAAVTLEAGDARHVLGVQAQVARQQVAGEVLAAGRGRNHRVAQLHRPGQRHLGDRGPVPGGYPGQRRVLQYLAVGQGHVRGDRDALLLEVRGQRAVLQVRAEFDLVGGYLARTDRGDGLAGPVRC

SEQ ID NO: 32364 - protein, 351 aa, Pseudomonas aeruginosa
LFRAPWLVTANAPALDSVPPWLSSQADFTVRKPRLSRLPAWLSNAPARETSIPFWLDSRPPAPLNNSVALRRSPSRLASTPLSWLSMRGVVMSRPLSPTILPPRLSNCSRALATTLDVLEISPARLSINRELKSRSWPATMRPLRLSSRSAFRSVRRSLTSLPPALLSRRATSMSMSPLLERRPALRLSSAAAWTCSSFRPTTWPPRLSRSPRVLTTARSRLCNRPSWRLSRLLASTRSSPSASSLPPRLSRCPPSTRTVAPFRLPPWLSSARLAFASSARLATRLPALRRVPLRSSRSPRALRRSSGSTPASITPALSICAASSAMRSRAARLCRLTSSSALRISALPPA

SEQ ID NO: 32365 - protein, 135 aa, Pseudomonas aeruginosa
GPGEVKQGFPRERASMQVGAFLKRSGGRRVFRRTRRPGNRSGARAARWRWAAPASGRSRRWRRNSGRGHPVRWRCRSCARWRRRCSGRGGSRRRRRRRPRRIPAARAAAAPIPPHAASATGCASSRRCRRSGSGP

SEQ ID NO: 32366 - protein, 245 aa, Pseudomonas aeruginosa
IALSRSRGLFAIAPAGRRPTRPPRLRAGRPAGLRWHGRGAVRRASTCPPRPRRESPAPAWPPGRARQGARPPAPSRWTACRCHATIRCWPASTMTPGGRPAAAGRPGSGPCRACCGSASRAARESSRIAARLPSPARRSGPWGYRGAPSPRSPRCRARRSAGWRAAHSCPGAPPPHRAGVSPAAREGRSWCLRAVPPGPRGSVRGTPAMRAAPGSARRPATCRGAPGCRCRCASPRGSAAPAPSR

SEQ ID NO: 32367 - protein, 1418 aa, Pseudomonas aeruginosa
TGTAVATWRRRQPRPLRQQHAAAAPSADDADFAAVQLPVRAQPRGPRAPGAPRTARSLGRPQAALRQPGHRRLGHADHRHLPATAAGRLPRAARAQHRRQRLFGGGRQRRGADRRPALRLRGQGSVRRALLGRAAPGSRRHRLRAVQFLRPPCAAGARHPPRIPRNPRPLKDPSHEPSLRARSTRQPHHPWQRPDLPGAAGLLRRPQLRRPRPGNGLRSRARAAVLLLQAGRRGGPGRRRQHPGAGLPEPDRQLPLRDRTGGGDRQGRLRHPPGAGRGTRLGLRGGPGHDPPRPADAHARDGPALGDRQGLRPLGADRPALPCQPGRPSAPRRHQPPGRRRGSPAQRHRPVDLVGGGNRQLPVALLRAAPRRPGLHRHPGKASARSSAASGCSAPSTASANSASAWSDPPPAHGAGPPCPSSGLSPRRRPRNAHAYARQEQQDRRPGFHRCAGGFRLPVASPVAVLPDRRHGRIRHRRHRLHRPGPGPRLATEPGATQPDPRRRAGRPGPRRLRRRPAGRPFRTQERAPALGTVLRRLEPRLGLRRFGGNPGPAALFHRPRPGRGDAQRDHPDLRILPAPAPRADGHRDVLRLHPRLGAGRPARRADGPGAGLGKRAAARRRPAPGEPAAALGMPAGVGALPRPPRTGRGAPAAHPRTPGAPARRLGRTPRTARRRVRRHLAPAADPRRRAARRHPAALGHLFHGPADHLPADQLAADADRRHRLQSRRGGDDQRHVPARRHPRRTPPGQRHGSLRRAPGAEPGLRRRRPVHPRHRQPLPQLRPAGAVRRRRRFLHQRLAGRRQRPGRRFLSDPQPRHRGQLGPRPGPHRLDRRLPQRRRPARPGPGLQRHPRPAGNPGAARRRGRASPGPAPGQAFFRHSLNRTSHAALQLLQQLHVLSGAYRIGPERPGLPGSAGQPAAGRATAPGRPPAQPDGRAADPGRRRRSPVQPVAGDHRLPRRRAARTALDPSRPTASRPGAGTGPAGGLRHPSAEQRAGAQVPDPGPRHRRRGPPALVRALGRRGPGGGGDPAEPTPSRRLLRRRRSGHRRVLPGTATGQRPAHGLCPGALPGVARTGGALPGARSLPARQPRAPARLPPGLTRCPVENNNKKDTPMTTRIRTSLLALPLLLPSFQAIAALPGMNLGQTSFLDGKALPGTLFQQFVNIYEADDFMDANGHRRPLDNRLRTLLATSHFAHISQHQLFGAYYGAEILVPVLLADPDFEPHAGSANGLGNLIVSPFILQWPQTELFGRPYWQRLNLAFQLPTGRYDRHRAINPGSNHWSFNPHYALTWEFAEGWEASARLQYLLPGKNRDPAPPLADDYLQPGQAFHANYSVSLALDAHWRVGLSGYSLRQITDERVDGHDRPDSRERVDAIGPALMFGWGKSRLFLNAYHEYGARNRSEGSRLILRYSQVF

SEQ ID NO: 32368 - protein, 148 aa, Pseudomonas aeruginosa
RRSPPGPEQRAEHGGEQAWPGEETAIADIQHLCEVAAVLRPVAHHESQARHQQAEQQQVEQHRLGVAPATARRQPTAEQRGAEGEEQQQVLQRDHQRPQGKTQHQPRSRVACQWARKPPASTSPVNRRARRSSPSGPIQIRLGGPGTW

SEQ ID NO: 32369 - protein, 319 aa, Pseudomonas aeruginosa
SKAPGQRRGHARPHQQPGQRAERGRAGQAAALAAATETVEAVAQGSRQLQFEEAEHRQREEHEQRGEAAQQPRLLQPGLQVAAKQRRDHPESGVDQRHAQHVATGQQQAATRAGAAADHQPGEDRQHRQRTGSERQQQAEAEEQQQAPGQVAGLQAAGQALVLGDFAARPGGGRAGTAQVERLALRRIAQAGIGAALPAQAQLSGGGRRQGQFQALAIDLRLAEELVAVAFAGRQLRLQGRVESVEAQALLVQVVARRDLPAQLHLAVVEALPGEAEGFLHRQEIRLHRAARREQVVARLRLGQARQQEHQEQDQHTHG

SEQ ID NO: 32370 - protein, 259 aa, Pseudomonas aeruginosa
RGHGKTPATRRAGHNPGLIRPLQTPIPLTSDTAMHVLLTEDDDLIASGIVAGLNAQGLTVDRVASAADTQALLQVARFDVLVLDLGLPDEDGLRLLQRLRQQGVDLPVLVLTARDAVTDRVAGLQAGADDYLLKPFDLRELGARLHTLQRRSAGRCVNVIEHGRLSYDPSTRETWLDGRPVELSRREQALLQALLNNRGRILSGEQLKDSVYGFGDEVESNALNVHIHHLRRKLGNAIVQTVRGLGYRLGPARGDGDDA

SEQ ID NO: 32371 - protein, 566 aa, Pseudomonas aeruginosa
RWKCRCASDARAHPPTGPRRANSRPRLSAGPRPRHRRITPLALSALPPRRPASAGPGLRPADARPRGSDSLSQQHAVDLLSVQVDAVVGMELLPRLLHRTVHQARVLRALVAVHEGGDVPGVAVAEGTGLAQRHVVLDEGGRGVDAVHARAPVERLRAPQRWEHRLPQSHLALAVGAVADRALRGIDLGAALDAVAAFRRGHVRIAASGQADPGRRLARQPIGVDGQGLDLRAVSRRHLAVHAELEAALQALGERIDLVVLGTERRIDRVGRPLRRGVGPAALVEMAVDAVELVTDQMRCVLPGFHEQRLALADHFAEGVVREAAFRRRLERLRGRRCRVDGSDQQAGDGQGKDRRPCSWLASCLTEGGEELADAADLLFAEGFGDMSHQIVRVVAASAKLPGAQLVAQVHLALPLQRREGLPHAAAGRTVTGHALGNVALPGATHRQGLAGAARGGHARQLHQLGRRHCREGSGERLDLVVAESIGYALHHRVLATAALLEVVQLLAQVGGGKARQARKAGGGQAHAIGAVAGDAGRGGRVGAALCVEFLAVDDGLGRRRQQGGQ

SEQ ID NO: 32372 - protein, 211 aa, Pseudomonas aeruginosa
KQQSVCNRHGRVPLWLIVFSSKFRTKKPIAERPYRTQVYIIFPTGPGSRPFQLRDDFARAQPMGVLVEVAGEDKLVGAGLLQEDLQTRTNLLRTADHRQAEEAADRILLVGQPQRRHTFHRRLLFQALAADQRQHALEGGSGEELGLFVGRCGDQRHADHRVRFVEYRRGLEVAAVDAQRLVQVTRCEMRSEGIGQAFLRRQVSAEQARTE

SEQ ID NO: 32373 - protein, 427 aa, Pseudomonas aeruginosa
PDRHLGTLARHRQQALLGTARAEQHFQLGDLLGEVVAVAQAVATQGAHGRLVGAGGAAKAEVDAARVERLQGAEVFRHHQRRMVRQHHPTRADADPRGAAGDMADQQRGGGAGDAIHVVVLGQPETVEAQALHMARQVQGVVQGFGHAAAGAHRHQVEHGQGNISKRCHESSNRQRAMAGARDTRGRTSPGVWINSISRVIVFAHGESMGFFQPRRAVASGGLDRQQGIPGRHRAAADGQQLLAAGAVAGLDRQALKHAAVETGERVEIGSGRHVAVGHASCETLAQQARGAPPVIAQVVFDAFVGRREIGRAEVDQATARLAFGGVADGGAFQQRGDRLARRRQGEGALGKLALLAQVEFHRRTEQRLLGTIGGIHARRADATHGLLQRGHGRAFVAGLPEHVERPAQCLFTIEAAGASTLGHGNS

SEQ ID NO: 32374 - protein, 318 aa, Pseudomonas aeruginosa
SKAASTTDTSSARVPLSGAASGVFPIRHQRPQSRVAQFEEFQQPQCPDRRQQGAQVFFSLPPLRRGQFLLKQQPGVGDERADAALAYLHAAQADAVLSVGKDVFGFHGVLQARMMSRQATSAVEWPIIHPEPIIVAFPPNVSETPARPALRPAHRPRSQPHGLPPPCLRPALLPGARPSGGRGRAWPPGPASAPDRLDPTGSPTLGALPRQPGGLERLPRRRTLPRPAPAPRRARLLGFRGADRRTRHPLADRLRLEHRTREPAARAAGRTAPRRAPADPPALSGGFAPAQDRRGIDGQPRRSAAGGRMGTLGGPQQP

SEQ ID NO: 32375 - protein, 355 aa, Pseudomonas aeruginosa
PEPAVRRRDRHELRAMAATGATARGRRTAGSGPGGRRDRLVARLRKPEQLRQCLPRSIRRDAVRLFQSRQRSASLNLPRHEPFPMSHANTPRDWVRRAPQHGAVERIEAYFAGHGYDPHRHDTYAIGQTLAGVQSFRYRRSQRHSLPGGCLVLHPDELHDGEAGSQEGFRYRMLYVEPALIQQALGGRPLPFVRGGLSDDPRLIAASRTLLQAMDTPLEPLEEQDALFELAHALDAVAGNRARGRRHFDFVAAERARQYIHAHLERPLGLDELAQVAQRERWSLSRDFRALFGTSPYRYLIQRRLDIARRLMLGGQTLAEAALAAGFTDQSHMTRHFGQSYGLPPARWLRMLGRA

SEQ ID NO: 32376 - protein, 189 aa, Pseudomonas aeruginosa
STSSSSCACSSCRASAWPTSCSRPRRSATATSSRRTSASARRASRSRACATATRNRSPGSSTASTCASPAASRWPSSAPRAAARAPCSTSCWASSRQWRDRSAWPAWTLRNWAWTACANWSARCCRTTCCSPVRSATTSVSSTRNRTCPGCCSARRWLPSTMTSRPCRWATTPWSATWARCSPAARSSG

SEQ ID NO: 32377 - protein, 345 aa, Pseudomonas aeruginosa
ASTKAPRAWPNARPSRRGSRPDACLRRPVVRPARPGSRRRRLRAGRVRHRRPGRRPGGLRPRRQRFALPRRAATDRAEPGGSHRADPLPRPADPPRLGQCQGPGGPGRDRQVRLPAAPGRPSRRQSRLQRHGLSRCPLPLRRRPSPPAWRQPPIELGAVRLRPPQRRPAQRPAVAAGGQRQPGRDPAEHLRPRRPGLLRRPRRPAQPGRLASGRGAGGAEPGSRRRQVPGRRRRPFRSPAGADRAVPGEPRPGPRRRRPEQRPRRHRPAHGPGAGYPAAPLRRAGGATRHRLRQGHRRDARRSPPRASGAARRPGAAESRRRLGGGKPRRRPAEPGAERQPGTQP

SEQ ID NO: 32378 - protein, 475 aa, Pseudomonas aeruginosa
RPGDGVQRRYPRTRPQHRPATEHPVVRRLRTHLPGPQRPGPPRSQRSGAGRHRAAGFAGGVEQLPVAQRRDPQPGAHPRTGRTVAAKPGGGAGPLPLRGRQHDRAAQRPDRLRQRRGPAHPRPRQLADLAPATGGEPRSPGFLEPALKSPGSAAALYLSRLSGWPPSRRMHPAPATRDRMIDDIRYLIVFAKIAETGSVSGGAEALGLSAATASLHLSRLERNLGRALLYRNSRKLSLTQDGTQLLDTARSMLELYEKGFIEFRQRAVSTRNSLRISMPAVFVYGDFTRHLAAFIEEHPDLDLGIACDDSRHDIIGDGIDIAFRIGDLPDSSLKARHLFLLPRQVVAAPAFLARHAPLEHPRDLQRLEWIGLGMRPDSRLFRHARDDEEVRVDYTPRVRVDSVEASCRLARLGVGLAAPPTYLSDEPIRRGELRAVLPEWRLEPLKVYAVWPPNVPASSIAYTLINRLYEAFNPG

SEQ ID NO: 32379 - protein, 161 aa, Pseudomonas aeruginosa
RRRTARRRSATHAATGGHCPASDSRAGIPGLPRRVRCVRRSARFPRRGCAGSAPAGRCVRVAAAVRSGRRRGGSRDPRGSRRPPPAPPGRGGWRRSPGYPQPAGAQPPAAPPRPRPARAAGGSAGPAASHRSSSRNRVPPSACCSRPRIPFAAAPVKAPPT

SEQ ID NO: 32380 - protein, 267 aa, Pseudomonas aeruginosa
SMHATSSDDFSLSSRVALVTGAGRGIGRGIALALARAGADVAVADLDPQVAEETAAAIRSLGRRSLALGVDVSDGDSVRAMVERVATEFGRLDVAVNNAGVISIRKVAELSLADWDRVMNVNARGVFLCCQAELPLMQAQRWGRIVNLSSIAGKVGLPDLAHYCASKFAVIGFSNALAKEVARDGVTVNALCPGIVGTGMWRGEDGLSGRWRQAGESEAQSWERHQASLLPQGEAQTVEDMGQLVVYLACAPHVTGQAIAVDGGFSL

SEQ ID NO: 32381 - protein, 126 aa, Pseudomonas aeruginosa
SPCSAATARTRQWPPRSATSPCWRCPPGPTTPSRSCAKPPARGSPAASAPATGCRRRSACDATSACWCASRAAGSASGRWWTSRCRRSRSSAPAPSVAPKTSPKSSSASPNPTPSAFRRFADCGRR

SEQ ID NO: 32382 - protein, 685 aa, Pseudomonas aeruginosa
PREDNLENNKMSTLSTDQLLHAYRVMRTIRAFEERLHVEFATGEIPGFVHLYAGEEASAAGVMAHLRDDDCIASTHRGHGHCIAKGVDVHGMMAEIYGKKTGVCQGKGGSMHIADLEKGMLGANGIVGAGAPLAAGAALAAKLKGSDAVAVAFFGDGGSNEGAVFEAMNLAAVWNLPCLFVAENNGYAEATAAYWSVACDHIADRAAGFGMPGVTVDGFALLRRPRGCRRRHRARPRRRGAVADRSQADPLLRTLRGRRTDLPRSRRSKALPGNPRLPQAVPRTHLPRRPALRQRPGRHRRRGRGAHRGCRAAREERSQAGAGRPAARRLRVLSLSRPKTRTRRTIMARKISYQQAINEALAQEMRRDPSVFIMGEDNAGGAGAPGEDDAWGGVLGVTKGLYHQFPGRVLDTPLSEIGYVGAAVGAATRGMRPVCELMFVDFAGCCLDQILNQAAKFRYMFGGKAVTPLVIRTMVGAGLRAAAQHSQMLTSLWTHIPGLKVVCPSSPYDAKGLLVQAIRDNDPVIFCEHKLLYSMQGEVPEELYSVPFGEANFLRDGDDVTLVTYGRMVHLALDAAASLARQGISCEVLDLRSTSPLDEDSILESVEKTGRLVVVDEANPRCSMATDIAALVAERAFSALRAPIRRVTAPHTPVPFSDALEDLYIPDAANIEAAVRQALEGRDAA

SEQ ID NO: 32383 - protein, 483 aa, Pseudomonas aeruginosa
SRNWCSCSPTPRWSPGRCSRTCSATSAWKASMRPCASCWTTCSPTVASATTCVPWRARAASRSWRSGAAMTRSSRRGMPRACQPRWRSFPDRRTWCRWKPPSRSTACCSTSSASIEETTDMNSSPQANAAMRAAVWHGRHDIRVEDVPLPAEPPPGWVQIRVHWCGICGSDLHEYLAGPVFIPVEAPHPLTGLKDQCILGHEFSGEIVRLGNGVTGFAVGQAVAADACQHCGTCYYCRHGLYNICENLAFTGLMNNGAFAEYVNVPANLLYALPAGFPSEAGALIEPLAVGMHAVKKAGSLLGQNVVVVGAGTIGLSTIMCARAAGAAQVIALEMSSARKAKALEVGASQVLDPSRCDALGEIRALTGGLGADVSFECIGNKHTAKLAIDAIRKAGKCVLVGIFEEPSEFNFFELVSTEKQLLGALAYNGEFADVIAFIADGRLDIAPLVTGRIGLEEIVERGFEELVNNKEHNVKIIVSPGG

SEQ ID NO: 32384 - protein, 158 aa, Pseudomonas aeruginosa
RPRATSSATVMPSGASALCGSRPRRRATSRPGRLWISLPSSTTRPSAGANRRDNAASRVDLPQALGPTITLNEPSGMASERFRETVRASRRKVTASACRRWVMGGSWIRMARICGIDYTLWNRLHEKHYHMNPSARLPLQRKQPSCRPAAAPPCRYSP

SEQ ID NO: 32385 - protein, 366 aa, Pseudomonas aeruginosa
AACERSPRPAPGLPVAALAATGGAGLPGPRGGRTGAGGGAAGDRQPGAGPGRGVRQPARPGPGPHRPAHRPARTPATGAHRLPGRRRAGHGRGDLPVDLAQSAGLARRHRFHHRRRQRRHRADHPVRCRPAGHLAGGAGRRPLHGAGGGAAGAPGRHRRRLPPGAGGHRCRRQPVGPEQPAAGHRQPRPGDVCPALAGRLAEHPDLVARRPGSAGPARQRAAGAVPRSSPGIAGAGRCQRRPARRGGGARALADGPGRRRHDRHRHRRGRPHRLHRPGRPATGPAPDPLGRGAVAVRRIDGRGPAAGRRPARPAPGIRRQPADRPDDRPARRFLPALATDAQPPDLSPGLNDRPGCRRRRHRSPGR

SEQ ID NO: 32386 - protein, 158 aa, Pseudomonas aeruginosa
TRWWCAIPMRWPKRRPPTPAGRVASPSVRWTAFPTPPRTATWSRASPRLPAARRSRTWWPSAMPSPSSACAPPGRSAWARPTCRPWPTAACSAASTAARRARTMPPTSPRPSPRGPPMAPAPPPRPASPPSAWPRKPGRAGAARRRTTACAPTPLRAG

SEQ ID NO: 32387 - protein, 167 aa, Pseudomonas aeruginosa
PSPAAPTTTRRCCASPRPSSRPARGVSCRRVLHRWQASERRGRKASRLAPTLFRSRELSMQRLFVYGSLGPGRPNEHLMQKIGGQWQAASLRGRLLEKGWGAGMGFPGLAIDADGEEIHGHVFVSDRLAEHWPALDEFEGTEYRRVATRVTLADGAQVDAYVYALRD

SEQ ID NO: 32388 - protein, 418 aa, Pseudomonas aeruginosa
PAGRHARLDQAAQTLAHPLREESQALAVEIAHAAHIGAEMAAGDEARQGQLRQRGVVPVLQGAGDGHRRHQRRRQDHVADAQAGKQRLGERADVERPLVGVQALHAGGGPAGVVELAVVVVLDDPCLLPLRPFDQRQAALQRQGHAGRVMVRRGQAQRPRCLRLGEDRLGPQALFVDRDRQALQACGLEGLARAVVGRVLDEYPLAGVEQHAGAKTQRLLRTGQHQYPVGRGACATLQVDVVGDRLAQRFGTLRVAMGQGARAVFLEDLALQALPGRQGKGAGLRHAGSEGARDELLANPAASLHRLATPAQSRRAAAPSWSARAAPAGGQPGSRGDHAAAADPTLDEALGMQVRIGRFDGVAGYPQRLRQRPRGRQRIARRQRTVEDQLADRALDSRMQRQGLELWMEEARLDRLEQ

SEQ ID NO: 32389 - protein, 389 aa, Pseudomonas aeruginosa
PSRPAPGRIPRAIAGRQRPAHPFRPRGRGRPARTGPTRHAGAKRGTAASARRFRTERGGTGRRRLGRGRGDRCRHLPRRQRRPRRAQRGRHPGPGHRRHHRRQRVLHHAGDAHLDQAGDVDPRDPSVGQRGHPPAHGRPGHARPQRRGEGVHRPHRCKSTGRPRVKYAARGFGRRPHHVRRPGRRAFPPNTQDVISAADLAMFDRVEVVRGATGLMQGAGNPAAAINMVRKRPTQDFRASLQGSVGTWDRYRSEADVSGPLNSEGTLRGRAVVAYQKGNSFQDHVSSERGVFYGIAEADLSPDTTFAIGASNQNDNRNDNWVGLPSPLGGRHLDLKRSSYYGADWSYWDTDTTHLFSDLTHRFANGWQMKLAADKLWARINMLGLYNDC

SEQ ID NO: 32390 - protein, 116 aa, Pseudomonas aeruginosa
YSTTGCASMTQNPGDYRYTDDHDSYDAYANGPFQLLGREHELVVGASYRQERFDGHGGWGSLFNKDGTPTGPMDPTQWDPRSTLKPRLNTSLWGMKLDQEQKGAYLTTRLNLADPL

SEQ ID NO: 32391 - protein, 385 aa, Pseudomonas aeruginosa
FQVGVEQALGADPSLLAVVQLGGHQGDAGVAADAAVAAVVQHAGADIHRTLGADHAGTAVVEAGALQRHAGIAEQPAALVVQRGLVGQRQRTGAGEGPATVVQARGARRQAAFADQRAALVVQHAAEAHAQAVLAVEPTAVAVEQFAAVQAQAVAPGQHPLGLVQQALHGEAQAAVADDLAAAVVQLLAGVHGDLRGAGNLAGAVVDLPRLDSDAAIRGDQPGLAVVEHVGAKVQAPLADQLAALLEQRTDRRLQHASGGDTALVAVAHLVGYKLQAAFTHQAALFGVVQAGHADTGIALAADGSRTVVQDLRLDGQSVGRQDLPLETVVQCLGDAQGQSFAADQPPALIVQCVGGEGESTVAGYLSADAVVHHAELAQQERARR

SEQ ID NO: 32392 - protein, 266 aa, Pseudomonas aeruginosa
LPNTPSRMTSMLCWLLSRPPLPLNSSAPFRRSPSRLASTPPSWLSTRGAARRSPLSPMALPPRLSNCSATSSVTWPGLAISPARLSILRAETVRLPSALTRPPLRLSRLSASSISAPSLLNSPPAWLKAVTLACRSPLAAIRPLTLFARSAVSFRRPSLSRSPSSFSKRDTSISTAPLLPMEPLRLSRASARISRPPVPERTPSRLLSRAWAMRNVSTPPLRRRPPWLVSAVVVSVKARSLEISPPLLSTMPSWRRSKVPGVAIRP

SEQ ID NO: 32393 - protein, 408 aa, Pseudomonas aeruginosa
LERLQVAEGQAVLVVARIRVARLRVAATLRAKGADALLPAEVEVDETAADPPAMVEAELGLGDPRALVFQAGVFDIVVGALVAEPQAHGGLAHTVAVQHAFGAELVAAAVAIELEGEAAGLVARAVVALAVAVGEGPPAPGQAVEQALAVGMAPAVGHRVAVGAQVELVGQAQRAVPVQAQAHLLLAGTDVAVVVARGGDPPGLVALALETHPAAADLAAGHQLQLRLARRQAAQLVDQLLQLAQVEQLAGPARKAHRQFARAGQRGAVQALQAAFDDDDAQGPGGQVLLWQVGAGGDVAAIQVMVGDGLEQRIELADAQAAPLVGRQQLATRAFAEVPGAFQLDAADLEAALVVAGGIRSGGRSLAGQLLEFLQALALFVQQALLAVADQVAVAGGGEGGGAGKQRQ

SEQ ID NO: 32394 - protein, 105 aa, Pseudomonas aeruginosa
SSGSACSARWRSSRRRRPATGRRRSPGSGSSAAPTRRRRCGAPTGSRTSAGCGRSRPCSARHRRTRGRCAGRCGATGCRRPVRRRGSPRWDRVAGSLAGSGWCRR

SEQ ID NO: 32395 - protein, 272 aa, Pseudomonas aeruginosa
LQAVGRRLPAALGQGHVELAADRRAGRPENPVVSPHVFPVQRGGLGHGVTGARHHHDRLAVEHVAAQAGARRIVVQAPHHHIELAFLQPLEKAVHGAFEQFHLGPGVASEERPQCARHQARRGGRRRAEEHPAAAAAAHRLEVLPRPLHLGEYALGVVEQGHAIGRRAQATGVTLEQRRADVLLQFLEPLRQARLGGVCGPGGAAEVAGLHQADQQLQVLQAQAAGPVHRKPSSNTYRSMSKYHYSVMPSPRIMTIRPRRPRLLPPEIHRYA

SEQ ID NO: 32396 - protein, 351 aa, Pseudomonas aeruginosa
RQFHREARRLLSTHPPAAPHPALGSPAQPGPGATRRRLPGGAVALSRTAPVPARGRRPDQRRGSGAPRAGAGEPGPSRPVGDHPEPLRRPATDPAGRDRPQPPAHPVGPALRRRGLRRLHLGGRRTHPAWSRATSSSPRPGHGTTTATRAAAEGGEPVVWLDGLDIPMLRFFGATFAENHDEPVQPLRRGEGDSLARYGSNMLPLRHQPTTPTSPLFSYPYARSREALERLARLERPDPWEGHKLRYVNPATGGWAMPTIATCLQLLPAGFLGQPARSTDASVYSVVEGSGVAQIGGRRFAFEAKDLFVVPSWAELRLEAGATDCVLFSFSDRPVQQALGILRESRETLAH

SEQ ID NO: 32397 - protein, 711 aa, Pseudomonas aeruginosa
RTRPMNHLFAPEAPVSLTIHGSDQTFPVRRVYCVGRNYAAHAREMGFDPEREPPFFFCKPADAVVPVAAGSTLELAYPSQTGNYHYEIELVAAIGKGGCDIPLEQAEEHVWGYAVGLDMTRRDLQMRMREMGRPWEIGKAFDRSAPIGPLYPASQVGHPRHAAISLQVDGEDRQRSDIDQLIWSVAETVSYLSRFFELRPGDLVFTGTPGRRRRGRARRADARRHRRPRRTQRPRGLTHRPRTARAHPALHPGCRHGDGRGTLMPTPDKNNKIDVQAFIDAQAVSAFQLRVLSLCFLIVAMDGFDTAAIGFIAPALAHDWQLSPAQLSPILGAALAGLALGAFAAGPLADRFGRKSVLLLSVLFFGGWSLASAYAGSVETLALLRFFTGLGLGGAMPNAITLTSEYCPRRHRALMVTAMFCGFTLGSALGGLLAARMVPALGWESVLLLGGGLPLASLPLLWACLPESVRFLARRAPDAARLRRILERLGRLPDGWAGRLELPADESDGTSLLRQILGAELRGGTLLLWATFFMGLLIIYLLTNWLPTLIGGTGFSLGEAATISAMFQLGGTLGALLLGSAMDRFDAHRVLSLAYVGGALFILGIASLYHSFALLALCVAGVGFCISGSQVGANALAADFYPTRSRATGVSWALGLGRIGSIVGSLSGGALLGLGLGFSGILALLVIPALLAAVAVHRLGRRRARPSSVTL

SEQ ID NO: 32398 - protein, 218 aa, Pseudomonas aeruginosa
TGLPMQLYSFFNSSTSYRVRIALALKGLDYQVVPVNLRQGEQLRPADRQRNPMGALPTLVDADGRRFSQSLAIIDYLDAVQPEPRLIPLDPLHRAQALELALLVACDIHPLNNVRVLKYLTQVLGIDAEDRQRWYAHWVAEGLAAAETLLNRHRRGAFFAGAAAGIVECCLVPQLANARRMGCVLAPYPALLELEGRCLALEAFQRASPERQPDYLPD

SEQ ID NO: 32399 - protein, 155 aa, Pseudomonas aeruginosa
SCATRRSSERRLPGRSASAPGCGTPSCAASAGPSVPRPGRNGDAPGRAMRIAIRAGPGTRPGSSADHGRTPRAAWRSLAAIAGGRGRRTSPGRGSPRGSSARPSLQAESAGRRSPPPPGCNARRRAPRHRSAAVPPPRSPPAPGTAAAGRAGRDG

SEQ ID NO: 32400 - protein, 247 aa, Pseudomonas aeruginosa
DRRSPGSPRRPSTPSVPCCRRAACAPPPGSSPAASGCWPCPPAHGRAGPSAGPCWPAAQRTGFAVLADDADHDMPQLHLAGIHPGSRLLPEHGAVRAVRVAAQVDHARRVGTAIGDPGDMLHLLPHFLGQRRIHQALQRFAAEVIALGVEQVAGEYVLAVGRQVQRHALVLVFGGVAAQAIRGVEAAEDAGALLLDHADRRRQLLRRRGQAGVEEGQAQAKGDQVARQSHSELLVAGAAAAGSKASR

SEQ ID NO: 32401 - protein, 144 aa, Pseudomonas aeruginosa
RTTKARRATSRPSNNRLNSTGSALRPPPRAASQPPSSAAPRARNSSRCCSETTSGPREKLSISRAPGSPANGRGSRRRRLRRSTGARGAPRLPGRSRSGSAGRVPGSGAAARGWRRCPRSRRAAAGARPAGRRAHRAWRTPVSP

SEQ ID NO: 32402 - protein, 611 aa, Pseudomonas aeruginosa
PTGSPGCRPAPTTTCSSPSTCANSAPACIPCSGAPPGVASTSSNTAASATIRAPAKPGSTAAPWNCRDANRRCCRHCSTTAGGSSAASSSRTASMASATRSRATPSTSTSITCGASSATPSCRPCAASATASGRRAATETTHEPAPAPYPDPRLGLHPALVAGRGLDALRPARADDALLRPTPGGLGADGCRPAPAVAAAAAGGRPDHAPQRGATGNSQRHGLPGQLTARRSPGAEPCHPGAGAGQHRQRLPRPGNQRRAVAQLHRAGRRSAGQHRRPPGRARRAATLGGGGRRGAGDGRPARQPGPALARRRPGPGAAQADSRRPHPTWRRLAGATGAGGPAERTEAAGGNPEPVVPAHRPGHRTRATPDRRCRPRAAQPADRDQDPPAGRAHDRGRRRRAGPGPRRGRRRPSAPDAGPAVAAGAGGRQPVVRRRRAMQRRGRRPGSHARRRPRRRADVRAEAGRRLVRGAAGSPLGAGHRRAAQPAGQRRAPHRRRHPGGAGGGNRARLRALPRPRPRSGHRRNRPAAPHPAFLAPRQERRQRARPGHRPGYRATLPMPAGLRQPRGRPAGDAGNAAARVMRGPTRQPAPVGRIAARGYPPDRGPGIGG

SEQ ID NO: 32403 - protein, 278 aa, Pseudomonas aeruginosa
AARLHPQSNGLLSIPSQSSSLFRQMFPKPLPVPLFALRIDRAASRTASHRHACGQLYCLERGLLVVEDEHGRQALPPRQIAWIPPGHPHSAHSHGSLAGWSAYLAAEHCRDLPRHPGVLACSAFVALIVERATRWPTGSAWSTERENLLRVLLDELRHAVPQRTRLPYPGDSRLRRIAEALMANPGDPRPAAEWARWAGLSSRSLSRLFGAETGMSFAQWRQLARLHAAVERLAAGQAVGEIAWSLGYESPSSFASAFRAVFGETPSGYSSRANEALA

SEQ ID NO: 32404 - protein, 86 aa, Pseudomonas aeruginosa
RSKGDFVWHSHADTDETFIVLAGRLRIDFRDGAMHLGPGEMYVVPRGVEHKPFAEGEVRMLLVEPCGVRNTGDQGGERTAVNDLWI

SEQ ID NO: 32405 - protein, 273 aa, Pseudomonas aeruginosa
IAAMSLYALGRWIWYRPLRNATEEQIVEAVPAPGRAPLGMARPAGGTDQRRPAYAEAATVLPAAQRPAVRRGEPAGDLARRDHGDGRPVQRRHPDGLQRLQVAVRQPRRQPDRQVLRAAHAPVAGRAPGRHRAPGPGGQPRRHPPGEPPRARGEHRDPGPALPLRGTGALGPRRPRPAHRRRRVGGHRRPLGLRQEHPAQRPAGHPPASGGTDPHGRPGPCATGPGRPARTGRHGAAGRRAVRRFAQRQHQFLRPATGHALAAAVRADGCHPR

SEQ ID NO: 32406 - protein, 585 aa, Pseudomonas aeruginosa
HPGHADGLQHPGRRHGHGALRRPEAAGDAGPGAVQEAAHPVPRRSHQPPRRTLRTAGQRRHSSAAHHPHHGRPSARDHRLGGPRDSPRPGQGKPRRKHRAPGRTPGRRGAGAGLMRAFAGLLCGLLGLVPGAAAYEPDVFGTAGQVAGQAVYDLGGSGLPCRGGPPPTELSLEEAIERILCHDPQTRLAWANAKAQAAQVGIGKSAYLPRLDGRLDASRGYSDMDYRDAPYLSGDGHRHRRGASLQLSWVLFDFGRRSAALRNAQQLLLAANASQDATLQNTFALAAQAYYDALAAQRSLAASRQVAELAAQNLEAADAKYRAGAAALSDRLQAQTALSQASLAQVRDEGALSNALGVIALRMGLAPDTPLRLSGELEAQPDTGFVKAIDEMLAEARREHPALLAAQARLKAAAASVEESRAAGRPSLALSANLARSHSDQAMAFNGDTRERDRSIGLQLNIPLFEGFERTYQVRNALARREASEAELADTEQQVSLEVWNNYQSLSVETRSLARTRELVEQSRQSLEVVQGRYRSGVGSMIELLNALTAYASAEDQHIRALGNWQTSRLRLAASLGRLGFWSLR

SEQ ID NO: 32407 - protein, 438 aa, Pseudomonas aeruginosa
RSTRSARESSAPECGAARTACRAAGGRPAKARRSPGNATRPACCPRARRRPSKTWASSSSTWPARRTSPARPSPSTADSRYDPALADRRHHRQPGLRSRPASPHRPCRAALQHRQGIGGATPARRLRRHRHPPCVAAAGHDRHRRRRAPGQPDPPGPRRPLAVPGVPRHAAAPERRGYPPGGAAHGRARRGADRRARRRRHAQGSGRRGRRRPPAGAVHRDQQRLPGAARSHRRGARRRPLRQQPGAAGDRPATQQAPAGARAAPRALRVGAGGRRGVAAAVHRRPRHQSRRRPRRSLRQLRRTPRHRPFGALRTVVAGEPRGAPRRLDAPASGRPREPAGAAGAGPAGGLRGLCRRLPATRRGPRTEPVQRDPGAGRRARDRVQRHRPPEHHPRPFRPVQRRCAGHPRLRRPPSPAGRPANPDDPVKTTWRTTRCPL

SEQ ID NO: 32408 - protein, 120 aa, Pseudomonas aeruginosa
PSTASHFFAVHEAAGAAIERARAGEGPSLIEVKLTRYYGHFEGDAQTYRDPDEVKHYRETRDCLKQFRERTCHAGLLSASDLDAIDAEVEARIEDAVQRAKNDPKPEPDDLLRDVYVSYP

SEQ ID NO: 32409 - protein, 101 aa, Pseudomonas aeruginosa
AARKQERGEPSWRERSATSRPSTRRWPRKCAATRASSSWAKTMPAAPARPARTTPGAACWGSPRASTTSSPAVCWIPRCQRSAMSAPRSAPPPAACARCAN

SEQ ID NO: 32410 - protein, 229 aa, Pseudomonas aeruginosa
PTAAWSTWRWTPPPAWRARASPAKYWTCAAPARWTRTAFSKAWKRPAAWWWSTKPTHAARWPPTSPRWSPNGPSPRCARRSAGSPRPIRRCLSPTPWKTSTSPTRRISRQPCARPWKGGTRHEPDPYTDHAQVGPVDDRGSGGRLAQGRGRAYRERRRGARRGDRQDLQQRRGALLGRAAAQGGARGRDPGGRRAARRGGRGRGERRGDRRTGATLPGRIRTRRRGRWG

SEQ ID NO: 32411 - protein, 593 aa, Pseudomonas aeruginosa
HAGAGLQPQVVAQAIVEVQLHAVGVGLLGVDGVRLRHPRRNHHRDVVLGVLEIHEEQVAVQQQAAVEQAGAGEQFVVPDGFFLEVGPVAGGQVERHAPGVVAAADQAADGPVRGRGEGQGDFRQEGREGLLVIQRTRRQHRVAAALDAILLVAQAGGQGPAVAQAVVQLAEHTEVLLRVVEGRQPAQVQCLVGAGAGVVDPAHATDPVLLLAEADPRFVGGVLLADVGVALAARAGGAVHRGQRVLRLVEQADAVVEVIGDVEDAGVGVLLPAGHGGRAMVELVERAGRRFLGRAIAVVVGEGELALQARNSAGQPEQLGARVEGAEVLVGAAVLELRVVVVDEGVATRVVHRQAPGEVLRQRAGHCDRAAPRMVAADLRLVGSLGAEGRVLGVDDDRPGDGVGALGGGLRAAEHLDAVDVPDRGRAEEHLVVVQVVAIEVDRRPRHCAAPEHVLPVVRALGVLAADDRRAHRVGVDHVGTAIDHLGDRGVAGLLAVDVAGAGERYRGRRVLQRAFTFLAGHDQRLEGGGFVLGGRVFPGQCRWRGEQGGQRDDADSPVERAVRAGVQGSSPNGNDSLFHSGYHATRSFLNGE

SEQ ID NO: 32412 - protein, 342 aa, Pseudomonas aeruginosa
IPHCEILNLLRPSLPRRPTAPGNRYHGRRPRHRSADRSLWINRGEETEPLNTSQPPADEMPDAPGEKRSGTIQSVSIAARFLKTLANAEGELALGEVARRTGTGGSTAHRYLQSLVKEGLARQDPLSGLYDLGPAALSIGIGALKRIDAVDIAARHMKALAQRHAASGGVAIWTERGPTLVRWYRSAYFSINPLALGDILPIDNTACGLVFQAFLPKAVVDAARKQQPAHFRGSPPSRALLDEVRERCWAELTSHLLSNVTGQAAPVFDAQQEIVCAMTTVTDLGQLQSAEDRDALFHEGPAGQPVHRWPGTPPRHAAAAALNHLSPARRRRSRAAPAAACR

SEQ ID NO: 32413 - protein, 377 aa, Pseudomonas aeruginosa
IRPPGFPYSENSLHADPPPLRPAVTRPEPVRHPRRGRGAEAGADRLHHPERHRHPAGDGRTAGGQRRHHAKSPDRRQGLLLAMGEGRRPTWRRGALPQPALRHRSGDRPGSGPAGRLRHRRRQRRAIPCGAGGAGRTDAGGRLLETQLAGTGYRAGPAHRPGTPGAGRHPALRRLHRRSRRGHRAAAGPGQRGRLQHRRQLFHRPPGQPPGTPARGPRLPGGGTAGGAGGQGDARLGLPVHLAGKPARRHRRRQRVLARRQRRRRAGVPRRPGAGQPVGGPRKARVRPGPQFLPHRLLLGTADDRQRRPPFPLSHAPVRRKSAHAGVPDAPPAPARLGPARRRAAARAGGPGQPGAGLAAGAPGGHPGRPASRRSAR

SEQ ID NO: 32414 - protein, 628 aa, Pseudomonas aeruginosa
SPPGGTRTAPATHPGGAAGRRGAGSGRRADAGADAQSAGRTRPAGDQRRRGAGGDRRGRAVRPGEHGPVPRLRLPRRRPGRHRRIPSRPGPRDRHQPGAPGAGGCRLVSDARLADRDHRAERPAGSLRPLPPLGRRLAFRQRLRPARMAGPGHRRRAGRRLRPRRQAQCPGPGPGDRPGARRRPAPDLAARLPGGDAAGRRGDRPGRADRLRRPGRPAPRATAGRTGPALDPAFLGADRRRPAARRRHPRAAAGGAGGDRRRNRRFAARRTGLHRPGQALPPEPPVNGLHALRLGSLSLRWRPRAALACLVLAGVGLALAAALLGTGSLALGPAEVFASLLGQGQDPTAQRIVQRVRLPRVLTACLVGAALGMAGAIFQSISRNPLGSPDVIGFTTGAASGAIVQIILFDAGPLATSLAALAAGLCTALAVVLLARRGATAGGYRLVLVGIGVGASLSGLNSLLLVTGNLDQAMYAQLWLAGSLNTRTWSHVVPAALGLLANVPLALYHGRRLELLELGDASAAQLGVAVERVRLQMVLVAVGMTAIATAAAGPIAFIALAGPQLARRLTRSAGVPLLSGALMGAVLLLAADLLGQRLAYVANLPIGLMTGLLGGFYLLWLLMRSRRI

SEQ ID NO: 32415 - protein, 444 aa, Pseudomonas aeruginosa
RARVRSYHGGRTGPGLPGADRRLRCTRHAHRAERGGGAQSRCAGRSAGLRRPPGAWRAPRSAGRHSLHRQGQLPGQGPHRGFRQPGVQGPGGPARCLHRRAPARRRGDLPGQDQHAAHGQRRHAARRLRPRGEPVQCRLPHRALRLGVLQWRRHRHRGQLRRLRPGRGNLVERARPGVEQRPVRLHPFARGDLGARQLAADADHGRGGALCAEHGRPAGNPRRSGRRRSRYSRRPLAHAALGADPQGLRGTPGELPGPGRRRRGPGRQALRRAAHVHQRRPRCGHQRVPRDRRPDRPAHPYPALGHRPLGTGAQGPGSRRRRSDRGGLPAGVELRRRPTRRAHRVQPRPGVEGIPPRRAVGTLGLGLRRLPARQWRSEAEPPGGCRRPADLPPRPRHPAQPRGRPGRRHGRIRADGRARHKALGPDRDPPRWPARPRGNPADRP

SEQ ID NO: 32416 - protein, 170 aa, Pseudomonas aeruginosa
VRSGWWISRPHRPRRWPGGSSSMLKLETPIRRVRPKGLGFRQRRHVLRQLDAVAGCRPMDQDQVQPVGAQFLQTLAQAGEQLFAGVVVDPDLGGEEQLGTRYAALGDRAADIHLVAVDLRGIDGAIAQFEGAAHRVDDDLAGKAEGAETEGREGVDGGRHGCAPWAGWLE

SEQ ID NO: 32417 - protein, 212 aa, Pseudomonas aeruginosa
TRNAAGRANGLPAPPSRTLQMKHVVSSALLLGLSSLSLAAQAAPIALDLPAQPLAASLEQLQGASGLRIRFDRAAVADRRAPALRGTLEPSEALQRLLAGSGLSGEVRGGDAWVEAAATGAGISPGDSVDLGALSVVATQDPATAAITEDSGSYTTRAMRTSTKLAMSIRETPQSVSVVTRQRMDDQGMRDLNDAVKGFTGLTVAKVRAGPG

SEQ ID NO: 32418 - protein, 145 aa, Pseudomonas aeruginosa
PGGSASPTSTSNWTRQAIAAVGAGEISTNQIELSPYLQNRALTAYLEEQGIAVTSYMTLAYGKVLKDPTLAGIAARHRATVAQVALAWAMQLGYAVIPSSTRRENLASNLLARDLRLDAEDMARIAGLERNGREVSPQGLAPAWD

SEQ ID NO: 32419 - protein, 1011 aa, Pseudomonas aeruginosa
TKSRCIDNSLERKSVGARREAFRPRLSLACQRWSTRRHDTPRAGRLEGRGEAQQRRVVVGAAGEGQAHRHADVGHHPHRYGDRRHAEVADGEVAVGDPDTVAPGDVGRGRVDVGVRRADVGDGGEEHGVEAQASHPLLKVDPPGFLEAAQAIGEGRDPVPGLYAALGHPHVFVHAGGQVALAVGQGAGVVGEDLRAVDIRQAVQLRIAIGAQEVVEAPGREFPQLVVEEFLRHQAAVEHGGRAGSVAFAVRHQREVHLDHFGAGGFQGLARLFPEGDDRGPGMDALAGRAADPGGLAGARIGVGVDEHARHAEALAGQGLGACGQGRVARRAYLGGLGDRHPGLHAPEVAASIGIVGDHYVEDFQQVGHAPRIGHHHVHGRRQRPVAAHRDHPARRGVGAQAVVRRRAAPARPGFLGQAEGGEAGRGGGAGAIGGPRGEGRGEVGGIVRALRAAVDAALHAAVGHGRHVGLAQADRPGGAQALDGEGIALGHQVLERRAAGSRGEALDQVAVLGGVGNAVQRTEGLATRPAGVGGLRFGQRIGIAHHHRVQRGGRAGCIVGVDPRQVGLDQFDRRGTTGLERVTQLGDGNLGDLDHAVTAWRMETGRPLATLIIVPLVLCLLRRGPRGGRVDTGDAVYILAGARGFPGGARQRPRRSWPVSGVAAEARRRRKSAGCRRPPARRKVRRRGDHFTQGNRHDESSYRAGHRRHPWHRPGPGQALGGLRLECNGHRPPCERQLSWTSAVLRPGRSCANRRDAARIALGKRRGCLGQQRRDRLAAKPGEPRPGRSATGLRPQRAGRRAACPGLPAGAQAFAGGPHRQPVQPGDPRRPRTHRLRRGEERAGRGDSHLGAGAGAAGHHGQRGGARADRDRAVPPDPPGRRRGGTADSLDHPHAAARAAGRSGRADRVPAQRGRFVRHRPGDRCRRRRQPGRSLRPGLKSGGCASVARAGRNRRAGRSSGRSAGWRRMPGAGRAGRRPAAGPRPSMRRTATAPRPSGSGAGPVAGRPGR

SEQ ID NO: 32420 - protein, 253 aa, Pseudomonas aeruginosa
APVAGVRAGRCAGRWGPGPGRAGWRTPLPGPAPGCRSPAAPPPAPVRPPRGPGRPAPPVAANAATGSPGAGRGDRSQAAQAEAPDQDDEGRSAEQQSDDSGGDLRRRRQQPPEDVGAEQQAGGDQRRERQDPALVRSGQQSREVRGDQADEGDRPGQGGRRAGQQHHRQAGEQPGQAQVDAERPADLLAQGQGIEPGGEGEGGGQPGADGQARPSEQGEAAAGKRAGGPVAEAVEDFRRGVQHDDPGQRGEHH

SEQ ID NO: 32421 - protein, 461 aa, Pseudomonas aeruginosa
QAGTRQHQAHRVGAGLAGLAEKEYGDAGQAGAEEGATEVLAHARQVEQRDPDDHRQRRAGVDPQQAGFGQRIARQRLHQRAGHSQRRAGQQRHQGAWQAQFAYHQVAIIVRIDGLQGVQGDRQGHRPRAQRQAGQGRQREQQRAGEQAPGAQAPAAHRGRLHERTSGERAHGSAEMAGDVVDHLPSRVIVDAEGTGAQGVHALFADRRQVGQHRVGEERLHVVVAGAEQEHAVAGDGGGQVFPRDELEVRGARHLARQRLRQFRHLEAEGLEQACLGAGLAADGIAAGDVVADHADRALRRRDGRGDFGGVGVEALDGGLRLAFQAGVPAQLGSQFLPAVFRVVDHQRRYALRLQLRTVWRGAVGAGGGGDQQVRILGDHRFDVEAQVAVEHLDATLVGDLRPLREEALGVGQATWRGGGAGHQRCVHRQQDAGDARGGGDDPRRLRLPGRGEGGEQAQGE

SEQ ID NO: 32422 - protein, 279 aa, Pseudomonas aeruginosa
SIPHIRAILIQEPPMTHRLHADAVTLRRDARTVSRNLSLAIPEGSFSVIVGPNACGKSTLLAALSRLLAPAEGRVVLDGRDIHSLPGREVARRLGLLPQSALAPDGITVAELVARGRYPHQSFLRQWSPADERAVAAALRATRVDGLAERPLDALSGGQRQRVWIAMVLAQETPLLLLDEPTTYLDIVHQIELLELLAELNRQGRTIVAVLHDLNQACRYASHLIAMRDGAILAEGAPAHIFTERLVEEVFGLRSLIIADPVSGTPLLVPRGIAADARG

SEQ ID NO: 32423 - protein, 407 aa, Pseudomonas aeruginosa
PRQRHPPVQPGAVLAVLGAPHHRRGRRGRRRHPPEERLQRIAGQLRRAGGPDQWHGRGLLRPHPHRRDTAPARAVGLRRHEEEPRCVRRAELPPERPLDPDHRPALPGGSHRAQRQLGAGAASAGLPEDLLGLPAESLPGLRRDPGLDRRRPGQPRLQPRGRVAQPDHPQLGLLQGRNHLELRTVHPRQPARRPPAAERQPVLHGFQGRPVQHPGGGFAGGGAVVHHQRREGPRLRHGAGPRLSPARRPAAEGQRRRATHPDRRDVRQYRLRAQRVRPLAGLYPQLRTELGRHRAPQPERPGALPGRLLLGHRQHQGLLDQGLHPHRRPRQLPLQRPGAALWLREERVRRPLAHLHAGKPGDRRHRGEHDAAADPRHRHQGHLLGAPRSRPRAGPAQPQSPYRRLAR

SEQ ID NO: 32424 - protein, 341 aa, Pseudomonas aeruginosa
VPRNACTSACRWPPPGSAAMPGGAPTAISKASSAAISPSTSPGAPKPPTSTSCFARTSAACHWTCWRPAPASPAWIPPYCLPRSPAKPRGSAWCRRSPPRSIRPTWWPGSCNRCTGSATVAPAGTSSPRCRATRTSAWTRCPMRSSATRAPPSSPGWCTTCGTASPARHSWSTARAAATPTFPGCTRSTTTANSSRSRDRSTCRPSARRGFPWCRPAPPRAGATSPPRWPTWCSRRPRTRRLPWNCAATFPAAPNATVARRATCACCRASACTWRRAARRRGKSSCRPTRAWTARASSPRSGRCSASTSATGRWTGRFPRPTCRRRWPTPAAAPTPTCCGA

SEQ ID NO: 32425 - protein, 254 aa, Pseudomonas aeruginosa
PRPGRALVHNNSTGRLFRSPLRVSFSRHVKIAMSLSRRIPAALSPFQNRVIGACLLGGLLAAGAPAQAEEATGNARWVSDSLTTFVRSGPTDGYRIVGTLTSGQKVELLGTQGNYSQVRGENGSTVWIPSRDLQEVPGQAERLPQLEQKVAALTAELDGINDTWKTRVQGMQETLDTRKKLIDELQAARSNLDAELGKARSDLRAVQAQLGDENKQVLMRYMVYGGSIAGAGLFAGLILPSLLRVRRKRNDKWF

SEQ ID NO: 32426 - protein, 156 aa, Pseudomonas aeruginosa
ARAPSNCFSVETSSKKLNSLGSSKIPTSTHLPALRMASMASLAVCLLPMHSKLTSAPSPPVRARISPRASHREGSSTWLAPTSRALALRAEDISRAITCAAPAARAHMMVLRPMVPAPTTTTFCPSRLPAFFTACMPTASGSISAPASLGNPAGRA

SEQ ID NO: 32427 - protein, 164 aa, Pseudomonas aeruginosa
WARSGRPTLPAIDDRLTIRPQRCACISGSSAWQQRNTPRALTFITRSQSARLSSATLRMLITPALFTATSSRPNSVATRSTIARTLSPSLTSTPRARLRRPRLRIAAAVSSATCGSRSATATSAPARARARAMPRPMPRPAPVTSATREDREKSSDDVACMLHL

SEQ ID NO: 32428 - protein, 522 aa, Pseudomonas aeruginosa
VYAAGRWEERTVRPAVAVAGARPMPGCGVAAGRPVVERRHGKAGDRRGDVRRDNPCHRARVPGETLRRSVSVVGCGGPALVEGRRWALNGRHNNKMPSNGGPMLSAHSKDHVDCVSRVLRNAARLPQAPVPTPILDSWRRSMEQHRLDPGSLQGPRILSQTLLDECRERSELFLRIASEEVARLHGRVRDADYCVLLTDAQGRTIDYRVESTIRNDCRKAGLYLGTCWSEGEEGTCGVAAVLTDRTAVTVHKRDHFRAAFIDLTCSAAPVFDPQGELLGVLDVSAVQSPDDRRSQHLIRQMVAQSAREIENAFFMHSAQGHWVLRAHRAPGYVDSQPDYLFAWDADGRLLALNPAARHYLRQRLGQVPSHIGEVFDLDALHAAADQAPCLLRGQAGELHVRLSAPRAKARRLEREVPDDAALDPRIAESLRLAVRVKDRNLPVLIQGETGAGKEVFARQMHQASARRDKPFVALNCAAIPESLIESELFGYVGGAFTGAAAKGMRGLLQQADGGTLFLDEDR

SEQ ID NO: 32429 - protein, 636 aa, Pseudomonas aeruginosa
RRGRCSGRLRRGPGRGSPGTARSAPAGDRKGRRRRPGTWRRRLPGSAPPAPRPDARRPGCAGRRGRRSRPGRRGRRCSAGSRPGWRWPPAATAGRCAGRRCGGRSRTAPSSIGGWRHAGGDGRRRRGRGHRDNPCRCSRDWRRDGRPGAAGRRTCRSRPGPPGPWHWPRRGGSAGRGRGSARWLPPGSARSVAARRGRANRCRRGRRPPGRRPGRRCRTRPARRRRRREPGRAGRTTGRRRHASGLLPRRDGLAFGQARGAFVEAYLALAEDYHAVRRGDGLGPMGDHDAGDAQRSNGGVDPLFAVYVEVAGGFVEEQDARLLVQRPGQHHPLLLAAGEHRAHVADQGVVAHRHGLDVIVDGSHLRALQQPGHVRLRVEETDVVAERTGEQHVVLQHRADQFAQAVQAQLRKVQAGHADLSLHWREDAQQDVEQGALAAARGADDGHRLAAGDAQVEAVEDPGLLFRVAVAQALDLDARLALAEVLREDVAVADLRGLEHDVGQALALQLEHAQLEELVDQAADAAVELRLVGVEGHQDADAELAVHHHGRAEPDHQQVLHAEQQAVELLVEQLQLLRTQAGVDLFHQQAEPYRAALVLALEQLRRSAPRWRCATAGTRSSGRGRRGSWRRFSSRT

SEQ ID NO: 32430 - protein, 208 aa, Pseudomonas aeruginosa
GPPSVPIRPPAADRRGWPSMPRRSCAGANPPDRAGGSAGARRGAVRPAARAAGSRVRCSRRSRSASGWRVRRSAPRKPSRRARRGAGAGRGSVRRRGRRSSPPGCRGSAPSVGDPVGSRRSGAEAGPGGHARPRPPEGRAPGSRAGRRHGGGRPCGWLRGRCAGRRAGRAGVSETFGGKATMIGSGWIIGHSTADVAWRLIILAWSTP

SEQ ID NO: 32431 - protein, 188 aa, Pseudomonas aeruginosa
ARSASFPRAPSPCRRRASRSPRCWKAPPSATPPKASRAVAWSTSARPISRRPTKASKTTCAITGGAPRACCASVSHEAWPTATCRPEPISTRSPVSTAACFRACRSRPATAPAASSCWPSAAARWRPGIPCWRSRPPDATARLGWKKPMDSPWAKTITRDIELIQTPGEVLPRVSRAPAIARCRLELS

SEQ ID NO: 32432 - protein, 147 aa, Pseudomonas aeruginosa
WDISPNPSAKRRSAASASSSPPSVRQEASHEHGRRSFPWPSPACWSLPSTRQRRPRSRSSRRRKAASRTTPSAKWSARARRCSWKPGRTHRIWSVTSSTASTAISTRAAGPTPRRSGRPTRSIRRSVPRTTRSIRSPSACRAASSSA

SEQ ID NO: 32433 - protein, 459 aa, Pseudomonas aeruginosa
TATSARRTRAWWTVRWRRRGRSSMPTTASTCTDRRSTACCWDRESDPRGLASAGRRPGPAEAGRRGGRADNANGVIRRCLGLGPADSRGRLFALRGPVGGWARASLAQRHFQRHPQAVRAAVEVQPALAALHDSLDDGQAEPAAAALAVAPETPGEVRQVGFGDARTVVADVEARAALRGFHRQLHPGAGGGVAHGVVQQVAQRGDGQHRGDFQRRLGQAVGQLQLEHPHVAVAGVVHGYPGGVLGAALHAVVERQAAFHPRQQQQLVQRPVQTVGAFLGVGQGLLGGGALGHARDLQVGLDRGQRAAQLVGGIAGQASLAFDGLGDALEQLVLGFHQRLQFARQGRQLQWLQRVGATSGEGVANPLERRQALAGAEPEQGQAAEQGDRHRHRGGHHHRALQHVALFQAVGGADPQIAGLHGEAAPQHAVDFLVAEAAGGAVQRPLRGGMALRQDFAAQ

SEQ ID NO: 32434 - protein, 278 aa, Pseudomonas aeruginosa
PRRWPGALLYIAQTGNALHGGLVLFSLGLGIGMPLLLLVTVGSRFLPKPGPWMNLVKGVFGFLFLGTAWILLRPLLGEALWIGLGGALLLVLAYAALHTARGLARHAVLFGAAGCIFGLWGAAMLLGAAAGADDPWRPLQVYAAANRGATPTASAHEAFLTVSQPAELDRQLAAAKAEGQWVLLDYYADWCVSCRIMEKQVFAKPDVLAALQGVRLLRLDVTADNAASRELLHRYQVPGPPSLIWIGPEGEERRARRLTGEVDAGGFLAHWQATRERG

SEQ ID NO: 32435 - protein, 175 aa, Pseudomonas aeruginosa
CSSSPTRARAPRPCAISSRARTCAWTTCCSTTAGSLASRSARSPCPPPFSTPPRAACWAAISANCPAAAWRATSKPSSRPLPPPQPGVPNETAAQPDHPWPGPDPPQRRPGHGGGGAAGADPHGPGEGRPHPRQLRRPGWPARLRRRIPEPGHGAVPDARRQARTHRPPVRRPGQ

SEQ ID NO: 32436 - protein, 169 aa, Pseudomonas aeruginosa
PQPRTAGAPGVCAAGQGNVAEDGAYRLDRRWPCRRAARGLPVQRPELPVLHHVLGAGATLGGCRQGAVAAYHGRHHPRGQRSQSAALLASKDPQKALHDHEQAGKASTLKPLAKIPAAVRKQLAGNMELMASMGAAATPAIFYLNAEGRMQQQQGAPQPDQLAEILGPR

SEQ ID NO: 32437 - protein, 468 aa, Pseudomonas aeruginosa
SSGPAPSRRPSILPALRQPSGARAMDDAFSEEGSAQPRHDAQRPALAPRSDGFDIHTYHPDFVADPYPLLRLIRSRAPVCRDQASIWWISRYADVSACLRDRRFSADPARLGAAGVRQGGASWFGHQQLQPLARFYDNFMLFNDAPRHTRLRRLFAPAFGPDAVRRWEARIEVLVEELLDSLLERREPDLLRDFAEPLTIRVAAELFGFPREDTGQLLPWGRDLAAGLDLAASHGDAGQINRSAAAFSDYLQRQARGWSDGSSRPPSGAAPSIFDGAAMLEAGLGLEDLVAAYAMVFMAAFETTISMVGNATLALLTHPDQLDLLRRCPELAANAVEELLRFDGAVRGGVRCTLEEVEIGGQRIPPGEKVWLSFLAANRDPEMFAAPDRLQLQRANAKQHVAFAHGPHYCLGAYLARLELQCALRGLVRRRFALASEPTDLRWRRSSVFRTLERLPIVPEGDAQKTCE

SEQ ID NO: 32438 - protein, 146 aa, Pseudomonas aeruginosa
WRRGADGRPGWQGRAGRSAPSGRRPCRSPRAGPSRACASAGRGGSCPGPPRSPRRVPRPAPGGCRSRPCRSPPPVRSRSGSCRSGSGRPAPGCCRRRPGPPRRPACRRRTAARARDRSPFPGRGRRSCGRRSRPAAPGRSGRCHGW

SEQ ID NO: 32439 - protein, 1118 aa, Pseudomonas aeruginosa
RAAPAAAPGAETAVVAGGRRRRGLGRSRQPALAAPERRLQHRHRRAAQYRAGRRHPPATEHRQRGRRALRRRPAPDSPRPRRDLPRQRRRYAIAHAQAAAGTYRARAVRGPRHPFQRTPARCRHLSQRQRGFGAHRCLRRASAAGSGGRGGAELSDRRRRRAAPRTAADGRRGLGRWPHRHPRHAPGRLPRRGRPLPQRLPRLRRGGRRPAPVRGLSPGRHRQAAAGARADPAGAPAATYPLVGEGGRRLSRAGGRVDACFRPERNALKIIFIIFVGFPRLVRLYRLNTLQRLQRIPFMTATAVVLRNAPSSLDFPRASRLSRSVRAALLSLAMAAGAAPLCASAAEAAAEHARPYAIPAGQLGDVLNRFAREAGITLSATPAQTGGYSSQGLRGSFTVQQGLARLLADTPLEAEDQGDGSFVLREAPAKDGDVLNMQAVEVFALGNNLGSTDGYLATHSQIATKTSKPLLETSQTVSVITREQIDDTASKTVQQAMRYTPGIFTGQVGASNRYDYVVMRGFADNSVDNIYLDGLKAMGDSGTFSSMQVDPYFLERIDVLKGPSSVLYGRSLPGGLVALTSKKPLYEDYRQITGSIGNMGQKEMGFDFSGPLDEEKRIAYRLIGLGKGSDTQFDHVKEERYAIAPTLAIDFSDDTTLTLQGYLQHDPNGGYHGGVPADGTLSHHNGRHISREFFDGEPSKDDFDRTQRMFGYQLEHRIDDVWSARQNFRYLDSDVDLSQVYAYGWSASEPNKLNRYFSGAREHLQAYIVDNMLQAEFATGAARHTLLTGLDYQRRRTVVDWRSGSASALDAFNPVYGDDAISYFPDDNHTRRLEQTGVYLQDLIDIDQWRFSLGLRQDWVSVTDKNRSTGSKADDDWEKFTGRIGALYLFDNGLAPYVSYSESFNPNAYSDASGTPLAPTEGKQWELGLKFQAPGSNSFYTASLFHITQENVASKEPQDNFYTSVGEVRSQGLELEAHTQLSDNLKLLGSYTYTDITYTKSLDGNQGHTPNQAPKHMASLWADYAFDAGPLSGLSIGGGARYVGETWADKENTLRVPDYTLVDARIGYDLGKLGLKGLDVSLNANNLLDKDYVASCYSLDFCYFGEKRNVTATVNYQF

SEQ ID NO: 32440 - protein, 421 aa, Pseudomonas aeruginosa
PSTRAPAPAPRYRPSSPARDVRAGHSPASPAVPWLPGAPMRPVLVLLHRYVGLATALFLFLAGLTGSLLAFHHEIDEWLNPGFYAVGEGGERLSPGSLVQRVESRYPRQLVWYMEYPEAGGHPALLATVPREAGAKVEHDVFYLDPVSGEEVGKRLWAACCFQPANLVPWVLEFHHNLTLPGNWGLYLMGGVAMFWFLDCFVGAWLTLPRGRPFWSKWATAWKIKRGNAYRFNFDLHRAGGLWLWLLLAPVALSSVALNLPSQVFKPLVSLFSPIEPSVYEARGRLPREQLGETRLDYDRTFQLASVEAARLGIVEPIGELYYSFEYNFFGAGFGDHDDPMGKSWLFFHGSDGRLLGQEVAGQGSWGERFYRLQYPIHGGRIAGLPGRIAIAALGLAIAGLSLTGVYIWWRKRRARHWNGR

SEQ ID NO: 32441 - protein, 450 aa, Pseudomonas aeruginosa
LSSGCRWLGFTAAACQRRPLHLPRRPRPDPRPPAAPAGRTAQAPGGTPATARQGSARRCGCLRRRRALLRDPPHRAGRRRAPRRKRASPTAGALPGALPGRRPAQCAAQGRHRPLPGSRLRHHPRLPATAGPGLRDPAHHRRRRPPGGPGQLRAGQPARTDDELSGQDRRAARPARAGATGRPVEPPAVAPGAIGAGARQRGRRQPGASQGRARQALAGLRHAQQRRRRQYRRAADGPGPGLGQPAGPGRPAQPARQPRRGDRPLAPFRQPEPVLQPALGLVDLHLRLQPERLPHAQRGQRLPLQARWRQPQPPVPRRTRAAPRRCEQDRHEPGAQPPAHQQLCRRHPPGRPEHADHRDPARLQPWPADRQRFRQPRPRLAAGHRRPWRAGSRPPAGGRPECALRQVQPDPQLPAAVPAMGRALQLRQPGHRAKERGRAVQPAAHQPRRQ

SEQ ID NO: 32442 - protein, 1116 aa, Pseudomonas aeruginosa
LGARLQGPDPDRRQRRLLAQPVALAACGGMGAAAALAAGIRRGLRLRRRRDPPRPLQRRRQRAHERQRHRTGCPRPLFRRQRRLRPLAGAAQRHRAARAPDLFPGRRVLLKTRRPPERFRKAPTCIEALSLGKPCLTSPGPYPPRSNDMDIRSPLNQCIALSLAGILFLNPIVAAAAGLALDKAAGGNTGLGQAGNGVPIVNIATPNGAGLSNNHFRDYNVGANGLILNNATGKTQGTQLGGIILGNPNLKGQAAQVILNQVTGGNRSTLAGYTEVAGQSARVIVANPHGITCQGCGFINTPRATLTTGKPIMDGQRLERFQVDGGDIVVEGAELNVGNLEQFDLITRSAKLNAKLYAKNLNIVTGRNDVQADSLQATPRAADGSEKPQLAIDSSALGGMYAGAIRLVGTEQGVGVRLAGDMAASGGDIRIDASGKLSLAQASSQGDLKIAAQAVELNGKTYAGGSAEIRSAEELVNRQSLAARERIALEAAHIDNAGVIEAGVEPDERRNARGDLELRSGTLRNAGSLVASRALEAKASLALDNQGGSLKGATVRVDGGHLDNRGGKLLAEGELRVEASSLDNRQDGLLQSRDRAVVKTRGDLDNRGGQVVGLNELQVQAAALDNRSAGLLSSKGDMDIEVARLDNSAGGKLVSERRTLLKADRLDNRSGRIVAGQDLDLSSRLIDNRAGDISSTSRVVASAREQLDNRGGKIVGDSGLDITTPRMLNQDKGVLASRDGLRLSATELFNGAGGLLSSQKGIDVSLAGAFDNQAGSLDSRGFLTVKSAWLDNQGGTLSSAGALAVTSQGALNNQGGRLASDAGISLSSASLDNSQTGAISGKGAVEIRTGNLNNSRKASIGSDAGLTLVAARVDNSQAGRIAAKGAIDADLQGLDQHDRGNLVSDTGITLDLNKGSLVNRAQGLIATPGTLLLRQLGVVDNSGGEISSDRAFTLATSALNNQGGRLLSGGALTLRIAQALDNSLEGLVSGAGGLDIQAFVLDNRSGSIGSKGAIDIGVTRLENDAGTLIAERGLKLVADEANNSKGSIVAKDDLRAKLGALVQNGGELTTQGALALDADKVDNGAGRHRPATEVWSSMPGRWTTVPARLPARAWRR

SEQ ID NO: 32443 - protein, 279 aa, Pseudomonas aeruginosa
RPPGACSRPGEQRQPRPYRRQRRAGGGGRYAAPARRRAGQPGEPGPSRRRARQQPVRADRREWRHRYRGAAGRQPRRRDFQHLEGRRERPRATGQPRRQGHRRQRLAPHRAAPAEPGQGGVGRARRLEPGRRRTVQRRRRSARQPEQPEREPRRRAGQPGRRAGQRRQPDGARRAPGQPWRDLLQRRCAGADQPGRAGQPGRQAAQRCRRDAAGRQPRQQPYRRDQRQGCGGYPHRRAGQQPQRRHRQQRRHHPGGRPAGQRPTGTGQRQGPARRQPER

SEQ ID NO: 32444 - protein, 190 aa, Pseudomonas aeruginosa
SKRCKPPHCASFEPSRPRSAAMSSTIHPLPSFGLGTFRLTGQVVVDSVRSALELGYRAIDTAQIYGNEVDIGRAIAESGVPRSELFLTTKVWVDNYAREKLLASLRESLEKLRTDRLDLVLIHWPAPGNGVELAEYMAALAEAKSLGPDPADRRLQLQHRTGPARPSPRSVRARYPPTRSNSALTCRTAR

SEQ ID NO: 32445 - protein, 670 aa, Pseudomonas aeruginosa
IIEGRPFVQAVTARVGQGAPPPSTAPGPAAACANPARDPPTDPRRCAGAGQSVAGLAGAGAVVGGIPRHRRSGLFAPACRGLHRASGRQRQRGRRGYPAVPRPARRGRSTTGRRRAATEPAWRGDAGWRRGSRAARPAPLRSRRAGDPHLSPGDLGAPAAPGPQGIRRARPDPWRPAGCRTAAPGDRRLRQPGAWRTRHGRPGTGADQFATGAGSLRQRAARRRRADIRRGPGLLRRAQGLRGRRPGVPAGPGRRTGPAARADPRPAAGSAGAVPDPVAPLPDRRDPVAGAPPGADRMGAAAAGMDHRGRLRQRVPLRRPAHRLRARPGRPRADALHRHVHQVAVSRPAHRLHGPAAGAGGADDRRPLPAGRAQRLAGATDPGALHRRRPFRRLCARHAQSLRRAPGIPRGAGGQASGRPGRAARAGRRATDARAALRGNRRNARHRGGIPRRCRAGRAQRPASRRATASGFPDGLRRLHHGRAGGGGRGPREDPARFACESLGRRQALSRAGRRRRHRPGRRRPALPGSPRAGIRCLRIHPARASARRGGRRRTHGRGFPRRRRRSPGPESPSRHPSPFPAGDRGGWPPAIARRSSASGVRWDGRGRGCRRRRVAASITPLNGRAWAQDAKPSARAFHLLASGGVRGGTIRREPVDSKAAAKRSSAESS

SEQ ID NO: 32446 - protein, 326 aa, Pseudomonas aeruginosa
RRSSSFLLFSACCDGGREAAGSIQGMQCTSWPALAASLAGRGNGLAGPGQCLGLPPKRGVGESPRAVAGRRRGVRCGVGGTISHRGIVMTNHRTALVTGATRGIGLALARRLAASGWSVMGIARHASDNFPGRLLCCDLADPAQTAETLRGLLSESAVDALVNNAGIALPQSLENLDLAALQQVFDLNVRVAVQLAQACLPGLKRSPAGRIVNLCSRAIHGARERTAYAAAKSALVGVTRTWALELAPLGITVNAVAPGPIETELFRQTRPVGGEEERRILSTIPMQRLGRPDEVAALIEFLLSEGASFVTGQVIGVDGGGSLGGR

SEQ ID NO: 32447 - protein, 700 aa, Pseudomonas aeruginosa
PEQVETAEQAGHQADRQVGDVCQALAEQVGGQQQDRAHQCAGQQRHPGRAGQAPGQLRAGQGDEGDGAGRGGGDGGHADGDQDHLQAHALHRHAELGGAGIAQLQQFQATTVVQRQRHVGEQAQRCRDDVRPGPGVQRAGQPELGIHRLVEVAGDQQQAVQARQAGADTDAHQHQAVAAGGGAPARQQHHRQRRAEAGGQRRQRGGQRAGIEQDDLHDGAAGGAGGETDDVGRAQRIARDRLEDRPGHAQRGADQAGGEHPWQAYALDDALGGGVLALAEQAGEHLCRAQRQAAGPQQRRRQRQSDPREDQAGQRRPWPPTQRQGAQAQGVETVHRRLRRKRLTRTMKAGPPSSKATIPAAISAGAASSRPRMSAPSSRPAAISAEKGRIQRWSGPASSRARCGATRPTKAIGPARAVAAPASSITARQASSQVRRRSTPSARPISWPRARALSLAARAKAAASPAPMARPGHPSRAKPLPESEPAAQWRKRSKTSGGAFSTMIPVSEASITDKPAPASTRRTGLVPVSRAWPRRNTAMPARPAPRKAQPRYWPMLARSNSATPTITASAAPALIPSRPGSASGLRVSACISAPATPSAAPASSATRVRGRRSSRTTRWRSSCGSTACRASRVTARGTGREPSARLARAASASSSAPASRPQARRRRRRIGDACMSGLPANGRMAQRKWRATLSIICRPE

SEQ ID NO: 32448 - protein, 706 aa, Pseudomonas aeruginosa
MEKRVIPIWRRSLNARTHRTLNRGIGVVTLSTLLASPSALARENPPAEDEPAALEALVVTGEKRERSLKDTASSVSLTSARDIDRKQTGNASVAEVINGSPNVVYTDSVGAPIIRGQDTQGPNNGQNVFWGGTVPRATINLDGHYLNYNEMFFGATSVWDVDSIEVFRGPQTTSQGANAIAGAIIVNTKDPTFSPEAAYQAEIGSYHSRRSSIAVSGPLAQDFAGRLAVDYAGRDTFIDYDNPKFQDSGTDQDFRALNARAKLLWLPSGIPGLESKFTFSHNDSNRPTQEAATRPFDKLDHRSTTMPSWEQDTNTSILDVAYDLDNGIRLFNQAQYSLSSVHRTTGAGGEGDADIRQKNASNESRVSFGEQEDRISGMGGVYYARTRTDETLHLRGLSAFDDTKKNLGVFGELNYRLSDRWTLTTGLRYQEDRIERSGNSVLAPRPLDYQKTFSAFLPKVSLAFAATPDWTVGGLVSRGYNPGGVSLNLTTRNWAYFKEETIWNYELFTRASLLDGRLLLNGNLFFMDFKDAQYNIPVVVSPGVAQSYTINAEKAHAYGMELDLDYRLRDDLRLKASAGVLRTRIDEMSGNTGYEHNEFARSPGYTLSFGPSWDVTERLNLNAQVRYLDGYYSDTANTKAYSIKAYTLTDARASYRFNDQVQLYGYVKNVFDDRSPTYMQENRGIGGIEASMTQPRTLGIGIKGTF

SEQ ID NO: 32449 - protein, 474 aa, Pseudomonas aeruginosa
APREAGPAQGRPSPRAHTGDWHDEYPETLAHRHVAGPHLAQRRCLAAPRQQYRRHLRQRFRRRHRQALRSRPPRLRVSPGRQQPATGRAGDRLRLRQPGSHRTACRGRPRNLADRPGVDGLHHVLSALRGGPAAAIAALDQQRSRRLEHRHRAAGPRELRPGRDARCGAALRARRRVHPAGARPVGQLPPRGTPGRPRERPLRRRFPGAPGRPRRRIPQGQGTAQPAGLRRGADSPGAGRRLRERARLRRLGGRPGVRADPGQGGCPGTAPRPFPPRRTPRSLAARRAPAAGLQPVPGGEPRGGAGNLHADPRAPGPRAQVRHDQADARPRPQRLAAGPADFRGRPAAAGGQPRQPHPHRPAAAPDRARDVTPGPVAAAPRGGFRGALAGHRYGGRCRRADRRLGRRRRHGRFHRRAGRLGRLAAAVPRTGGAAPGGEGAVPRALQRHYLRRAPGRGMMERAGDGRVLAAMVSE

SEQ ID NO: 32450 - protein, 156 aa, Pseudomonas aeruginosa
IPGRPGIRAGRSRRCRTSARGSAPSRAAARPGAARLPRGYRGGRARRRRASPRWLAGNCSCRSSPQCWRRKSSSRRLTCSAASICTMCACPGMISTWAGRPSACRAGMIASSLPQIARTGWRPSLATARRSLRWRPSANRLSSNWRRAASTPSRRL

SEQ ID NO: 32451 - protein, 161 aa, Pseudomonas aeruginosa
RRRRPSSSTFRGAGPLSPASSSAGTNSAWKRCTSASISSSLASPSTTTPSSAPTARVSSSRATLRRSTPEKGASTLLEILSVSTSSTSSPFSICAPSSLSQASTRPSVIDRPHLGMVSVWIRLMPRPSLPGPGARLPRYSPRRGCRGLPGRRRKAPAYGAR

SEQ ID NO: 32452 - protein, 360 aa, Pseudomonas aeruginosa
WFSSFLFSGGSGIGHVDVAQQVVRLRLGIVLRALHGILDARLDLGVDGVQVAGGEQAGVAGAFAELLEAVAGFPVVLYFVGIAVGLCVALEVSVVAGQLDFDQRRPLAGAGALDGGAGSLVDGEEVRSRRRSPRACRNRRRGRRCGRRPPTSRPRWPRHSRCSRRRTGTAGSTPRPGSSPRTPRLRWSRHRRRRPPPPHRCLSAWPPARRRRPAARRRRRFRWRRACLSPGRRYAWSRPCPGRPRSSCHRFPPSCRARLRPWRCSGRGRDGWRRCSRRRAGAPSRRRRRLPRRRRGGRSRVSRPWRTRRAGVPRRRGWCASRGRHGAVGRCSEWTSCCSPGCLHGVIGVRWPASRRWRAA

SEQ ID NO: 32453 - protein, 289 aa, Pseudomonas aeruginosa
PAAETPQPTSRPGASGTSRLSRASGCRRIQAPWGSSRLTGDHSPQSAERPMAWGSAKLTKTSARSSARLMARAPMNGCGDTATSTSAHSQSPRRGSRTSRRLLRRRPISGGTRLLAQRPPASPAPVASRSSGKALLVPVDSASRGTSPTSAATALCVPSPPSTAISATPRSTMRRAARRVSSTLWRSGMSRNSRNGQWPSRAWRVWLARSTAAAMPVMSGGSNAWRMPVAPKAASRRCTTDALSVLECSPAWAVRRRRSRPEAGLAMMPTIGEGGVIARIRRRRRWPGR

SEQ ID NO: 32454 - protein, 244 aa, Pseudomonas aeruginosa
SRASCSATLAEPLPARRRKGCAACCSRPMAVPCSSTRIGEMPLGLQTRLLRVLAEGEVAPLGAARRQAVDIQVICATHRDLAALVAAGGFREDLYFRLGGARFELPPLRERSDRLALIRRILDEETAHCGVRIELGEAALECLLGYRWPGNVRQLRHVLRYACALCGGVTLQLADLPAELRGEGRTPASACESGGGPERDALLDALVRHRWKPMAAARELGISRATLYRRVRRHGIRMPGQADD

SEQ ID NO: 32455 - protein, 271 aa, Pseudomonas aeruginosa
GAPAAGAIVKRGKSKPALSLAPLMPVGFPCSVPGSGATRSVAPRQEPTEETHARPAPASPQPDRGVRPMPLALLLAMGAFSLSLSISPGPVNLTIVASGANHGFRRTLPFVTGATLGFVLLLAFVGFWFVRAIEAYPRFFDYLGMAGAAFIAHVGYRIATADPRLALEENGVPGFFQGVLLQWLNPKAWIACASGVALFASPSTHAPLLVFMAIYLVVCYLSLAAWALLGDRVALLLDSPRRVRLFNRAMGGTLVLTAGYMLYLQLAASPD

SEQ ID NO: 32456 - protein, 149 aa, Pseudomonas aeruginosa
GYRRCCWRVRWAATPHTPSTAPGAIPAAPRATRRGGSARRSGRSAARPGRRRGGPGGRRLRRCRRAPAGCSRRVPPRRPAHDGIAGCRGACRARSIPAAAGRAGVPAARAGPGMPVPPLPGAAAGTGDGPSASCPAGRRCGRRCRCRRR

SEQ ID NO: 32457 - protein, 527 aa, Pseudomonas aeruginosa
AVAALHHLQALPRLFDQFAGARQAAGLDAERLVVVPHLQRNLLLGVGQLRFAGFAAGQGVADLVGAFEAFEQRDVQLQADAAVAFAGIAVERHRLVAMAACQVGAQRQARPAGGAAFLHRGGGGFQPRLGGEQRRMLAAGFGEHLVDGLDEAGVGLRLQLAGEAQRGIRRQAHAQGDDAEGVAQGAFVADLGEARLGQRGLRLQAIGKGGGAGPVLGVGGFQVLRRQLRDLTRGGQAALGGEGVVVGLGGEGEGVLQGRVLAGVGRQQQLLGVAQGGAAAAEVEQHPAQLEAGATPVAMAVAGEVGGIAIIHVAVAATGVETAVQARQVGGLADPDLGRLGLGIGPGEAGLRVVAEDPLDGFLQAQLGRWRPAAAGQTAAAEVVDRLAGDLAGGAEHVRLVGGGAGNQAEQAAQQAGEGTHQACSRAATAWRSARRAVLSSRLTLPWPRTITRSAEAMVSGRWATMMRVMRSARMAALTRCSQCTSRWLVASSRNRMRGFLYSARASITRCFWPPESTVPMSPTRVL

SEQ ID NO: 32458 - protein, 107 aa, Pseudomonas aeruginosa
NSCSFCVRRPALICSTSRPSHTERRSSWRWNSFDDLLLGGVAQRPVPDPAAEGVEAHGGDLVRAPDNSFEIFSKVISKAIMQELSSIRPVVDDDSFAPGDISLLPIR

SEQ ID NO: 32459 - protein, 253 aa, Pseudomonas aeruginosa
NRRQARLRPASGRRASAGGRCPAGAGSGSGRGWCRTARGNRATGSSVRAGRPAPVRRGPAGAPGARGCTAGRARRRRSRSGACRAPGCRPRRRGRGPVRTGRPVLPAAPAGYPWPVAGSGWRRSGAGRRTSPRARTAAAGRRGPAGSAPARRRASGSGTLPGCRPRRRAARRDAAPGSRPAGCGAGCGDSGSSAPRPGSGRWHRCRGDADRSRGRRSKPRCVPPHRVAGRVEPSRGAYWRGSWGKARGAEGSG

SEQ ID NO: 32460 - protein, 211 aa, Pseudomonas aeruginosa
TGIAPGARRVLGGRLRRRDHGRAEGGHGWHLRAEHVCRLWFQGGAVPFGGGTLPEPGVPAFQGRLRPADGARVDRRAAGKRRRQLHHRRQAARLPGRPQHDQFLAGQQRRRRLPARSPAARRAPAARAFRTRRGRRRRAGRSRSRRAHQFLQQRASGPVDPGPRRRQPPAVAGHRPLRDGGLGFPAGGRGRLTPQRALAGKSPWILRGQKL

SEQ ID NO: 32461 - protein, 332 aa, Pseudomonas aeruginosa
YSPVHARPGAGAHRRQRGRSPAQLPGPGAPCGAPGLQPFLAGRAPQHGWHRQLRHRAADRPYRRRHLADPRRLGWGDAAEPCAAGGGGKLRHPGDALPGPHRPRPWPRPRRRPGDHARLASRPPGQRRRLPRAGRRAGNAARPAPFPAEPAGGAGRGYPGADLATRFEPVQRSPGGAERLALCLRFAFRTALPARGAAHLPQQLPALGGTRQTLRDDRRAADRRTYRRRGRVPRHYRLPARAGADPRREPETEAAGGKYGAVVAAPRAGCGRQLLRPGGDRRSGEGSCASGDPPGADRRRRAYLHQRLLRARPSAALLRNRRGAERGVIRGL

SEQ ID NO: 32462 - protein, 701 aa, Pseudomonas aeruginosa
QPGDQGPDRLRLLAGEPGADRGQPARTRLSGRGPAGRRLQHRARRQGLCRAVRDLPRRRRPGPDGSGADGVPTAVGRAVVQLGRGHAPHQHRGLLHQVQHAAGQARYPQRPRRLGRRRLHEQPRAPAGPAPGGRFGGEDAAEVPCQRRRQPVRTEGQRRAAGTGNLTLVAWRPQDGDPVRRKQVGAGVGRITPTALSADAWASVRRIAAGGYSPYGGRLAGGPAHHSRSGISSVTRRPSARLSKSSRHWQRCTIAWTMARPSPLPPLLPWRQKRRVRCGRSVSAMPGPWSRTWKRAQPCAVSTASSTRVPAAVWRTALSSRLRSAAMASTEGTSSGASDKPSASFSSNIRTSPWPASCMATRAASSALHCTPSSNDRLPSTRASSNSWSSVRCRRSAPSSAWARACSAAAPSVMRATCRWVLIAVSGLRSSWAASPVRRRSRSMAWAMRWNNWFWVSTSGFSSLGRAASSSGSSESAPRRVRASRIRLSGARPWPAPSQSRARLPSRATVTGTAAATTTERCSTSRSSRRSAVLTRRSPACTVKLRHSTPLISWSRKPLAVLSSARSGVAWLCARTSPRSELTWQAMPLGIPSCSALRRVVWPSAGCGCGNCWSRPATIRAEAARRWSKERIICPRRSQSIQAAASDQSRMKAEPRIRVRRRRRLMRRLRRRAPARGGSRGRARSARWRCRACAAGDGCGR

SEQ ID NO: 32463 - protein, 493 aa, Pseudomonas aeruginosa
PAKSTPAASSPIGRRPGSAADAEFFPGAAGGLAATPAAVPRPRRRAARRLAGGARWRAQRRAGAVQPVVARPAGGAPGFRGALLAAVPRRLRTDAGYPRWRFPRLARPARRRARRAVLGLAATGATSLAGCRRQPRTGVLAAWQPGPGRLRARYAPARAEPAQRRRRVGATGRFPGPPAGDQPLGQLVPAVSARDAGAATGAGGESRRSVPLRQPGRERRDRAPFPPGREPAPGQPAVRQRRAAWPAGRLGRLAHHRFLHRRGPPAGQPSRRTVPRQPGALPRSLRAGRCRPRNQEFRMRLPRNLITLGLGLTLLNAGLATAAEELPAPIRMVQEKGARILGSFDAPDGLRGYAAEYQNQGMALYLTPDGKHVLTGHLFDAQGNDLSREPLERLVYAPLAKEMWQKMEHIAWIADGRADAPRVVYLCSDPNCPYCTMFWEQARPWVDAGKVQLRHIMVGIIREDSEASPLRCWPARTRRRPCTTMSRRARPAP

SEQ ID NO: 32464 - protein, 1180 aa, Pseudomonas aeruginosa
PGTRAAAGAGPAGWSGCGWSWACPSCCCFPRGSASVREVVGLALGAGALEGFERQAAPLQFEQRRVGRQDTAHAPGVGQLRYQAALDDARCGAGEEGAATVSVQQGLRRRQALGDPVRVPALAVLGVYAEDLGQVLEHPHVVQRMDVAGHQQGQFQRLGAMQWVERDQARFGLHGVEVVDDRQRLAEPATVGVDQGRQRAHRVALAVGRAQLLALPQVDRHYLVIQAFQGQCDTHPIGRGAVEEAVELHGKSCSESDGRRPGPAPAQAMHGHGGEQRRDYQQGEDAAEAQAQAEQGAAAEGADDRADAAQAEGPADPGGAAAGRIEIGGQGVGADLRAADAETDAGDAQRQQGEAVVEAGDAEDEQGAADVGQAQHPVRVEAIHGAAQEECAEGAAELEHGADRRRLAETEAGAADQRRQPVGQQVDDQQAHEKGGPEQQGAAAQLGAEDLPQERGAVGLVGGQFEASGPAVGQAPQAFEDAPQARRVRCAAGEEAHRLRQACPEQRQARQGQAAAEQQHAFPAQRRDHPRGEQAAQRRAEGEAAEHRGDHQRAVPARAVFGGQGDRVGHRPAQAEAGEKAQQGQGFHRTGVGRGEAPAAEEQYREQEHALASETVGQRAGGEGAEGQAGQRGAEDRAELRRAQLPVVGQGRGDEADGGGVESVHGDDQEAQRQDSQLEGGNRLRIDESLDVDLVVLVGRRHERSSAVAVATARMKGRVGPRRARAVGQTTRTLSSPRPSMAPSIRSPRSTAPTPSRGAGEDQVAGAQLEEARQVADGFRHRPDQLVDVAALAILAVDLEADGGVARMADLAGRVERADRRRAVEGLADLPGPAHLAHAHLQVAAGHVQAHRVAPDVFLGLLQGDVAAALADRRHQFDLVVVVAGLARVGQLQGAAGGDRDHRVGRLAEEERRLALGIEAHFPGVGGVVAADAVDPPHREGLVAAMDGEADGCFGREEMVHGTGPSVGEGFAGFAEDAERLLHRAVGETEQHAVGGAGFQAQLGPGGHDEQILGLEGEAPAADLRHAAAFHHRIDAGVGAARGLPEEAGRQQLQAGGDGRHGPAAGGRVDVAQLVAFPGIGPFEARQALEGLAAARVRVAEQRRSRRRRLMAQRQHVAAVAGEAVAFATSQRLYRFIMVFGEGGAEETQHRDVQAVQPDHRLAAFRGGAGCRGRAMSRTG

SEQ ID NO: 32465 - protein, 308 aa, Pseudomonas aeruginosa
GWLAMDWTRRLRLQHLQLLVSLMETGNLSGTARAAHTTQPGLSKWLKELEEDVGAPLFERHARGLRPTPYGMTLFNHAQRVLTEMERARQNLEAMRSGSGSRVLLGTSPASAPSLVPRALRAFLGRYPGAQVELLEGTMNGLLERLEKRQLDVVVGRLDNYAPRASLRCDVLYSEAIVVMARPGNPMAQTAALDWEDVRRYDWILWPPGSPIRSKLDMALTQGGRQPPAYRLESSSMLANIELLRGSDMLSIGSARVVEHLAGLGLVARLALEIPGEGAVGMCWRDEPHRDRASEDLLACLREGAAAE

SEQ ID NO: 32466 - protein, 351 aa, Pseudomonas aeruginosa
RRALRGRGAVPLLPAALRRMSGAVDGTRGRVDEAVVRQAIHWLVRLRSQPADDRLQRACAAWRAEHGEHERAWQQVSALNEELQGRFKALPGGVAYGTLDSSAQRLQRRQALKLLSLLVAGGAVAWVGRDSLPWQRLSADYSTATGERRSIELVDGTRLQLNTDSAVDVRYDAGQRLILLARGEIFLASGADTQSPTHRPLRVRTAQGLFEALGTRFNVRLQDAATCLSVSEGSVRIDAFGARPLQAPVAEAGQSYRIAADGVRRLERPQMDAVAWADGLIVTRDMRLADFLAEVARYRNGYLGCAAEVADLRLSGVYRLDDTDKLLQVLARTLPVRLQRHTRWWVRVVAA

SEQ ID NO: 32467 - protein, 208 aa, Pseudomonas aeruginosa
PVSTSGGASAGRATGTAARRLLVWLPPTPPEDGRMNARIAALGLLLPLAAGSAVAAEEGSSVKDAAKAAVSSAIETGKNLLGGVSEGITSGRQSAQGADGAKVVSDNAGFAEIGQVEVLKTEPRDQQLAVTLGFKNDSDATVRLINLTQTGALLVIDNDGYSNALVALANPDDVTVPAKAGIRQTFVFEGGAEGIKAVRLWGKDLPVK

SEQ ID NO: 32468 - protein, 572 aa, Pseudomonas aeruginosa
RELAGHRMLRSSYRAVVAGLVLLPLLASAAPFTSPGDRDLIRDRQQRLLDEQRKRLEELQQLPGKGAPAAADASGDDERCFEIRRIELEGAGHLGESARRQLLAPYQGRCLGVGQLNALLKAVTDHYLDRGYVTTRAYLPQQDLASGTLRIIVVEGRLEGLDSSALASPRELTMSFPGRTGELLDLRELEQLVDQLSRLPSRQAQLELVPGSEVGGSRVRLKGERDKPWRVSATRNNDGDVSTGEQQMGLGLDWDSPLGLADQLNLRANRDAVTDRWRHSDSQSLFYSLPWGWWTFTYGYSQSDYRTRNEASGFPFKLDGDSRSHQFRAERVLHRDGVSKTAMSLGLSHQRTNNYVEDTRLEDQSTRITETQLGFNHGRRIGSGFVNLDLGWQQGIGALGAQGRGHPQAGDPNARYDKYSLTLSYLQPFQLWGERFSFDSLATGQRSEDVLFSPQRISLGGNSSVRGFKDQTLTGDSGGYWRNQLRWRRAVEWAPLRPWLQEYGVAFAYDVGVIRHDRYNDGASGRMSGNAIELDARGRYFAASVGFARSLERPSAIERREHPIYFRVDAFF

SEQ ID NO: 32469 - protein, 990 aa, Pseudomonas aeruginosa
WAAPEWRRTVQWQRRPAQQPAKHRRHSGRRIGQSGGQLEQPGTPEREERSAGQPGRCSLQRRDLVAFQPGCVEQPGGRVVTDAGAVLRSASLDNSQGGIVSAKGAAEIRTGSLNNSQKGGIGSGAGLALVADLVDNSQNGRITAKGAIDANLKGLDQQGSGRLVSDTAIALDLRGGELVNRAQGLIATPGALLLRQLGVVDNSGGGEISSDRSFTLAATALSNRGGRVISGDSLTLRIAQALDNSLQGVLSASGGLDVAALVFDNHSGIVASKGDTRIGVNRLENEAGRVVSESALDLTAKQVSSAKGRIAAKGDLQVTVGTLEQQGGELASQGTLTLDADSLDNRNGGLVSADGGVTAEARQIDNRGGEISSVAKVALAVREQLDNRGGKVIGDSELSLTVQRLLNQAKGVLASRDGLHLDGAELLNGDGGLLSSQRLVDVTLSGALDNQGSGALVSEGSLTVKADQVNNQAGTFSSAGSLLVTSRGELNNQGGRLVTDAGATLNSTGFDNSRAGLVSAKGAVAIRTGALNNSQKGSIGGNTGVTLVAGLVDNGREGRISTQGTLDANLKGLLHHGGSSLVGERGVTLDLNGGTLDNHDLGLVSTPGALLLRQLGMVDNSVGGEISSDRAFTLAANTLNNQGGRLISSEALTLRIAKTLDNSLKGQVLATDGLAIESQVLDNRAGTIGSKGDARISVTSLDNAEQGSLVSEGRLELVADQVSNGNQGRIAARGVLEAAVGTLLQQGGELVSQGSLDLRADVLDNSQSGLIAANGGIAIEARQVDNRAGEISSTSKVAVNAREQLDNRGGKVIGDSGLRLTVQRLLNQAKGVLAGRDGLSLDGGELFNGDGGRLDSQNSLSVSLGGVLDNQGGALVSEGSLTARAARLDNRGGTFSSAGALALTNQAALDNQGGRLLSDAGVTLQGASLDNSRTGVISAKGAVDIRTGVLDNSRNGGIGSNAGITLVAAQLDNGQQGRVSAKGLLDANLK

SEQ ID NO: 32470 - protein, 380 aa, Pseudomonas aeruginosa
QRVGEVQPGGEVGAFLFLVELHAPQAGVQPRLESRPRVPLGRVHRPGGGAVLVEQAAPPAVAVEAFLAIAGADHQLVLAAEQLEGTVGIGVIAVVVVGVPVVAGVLGHAGAPGGRVLAVVVQPEHVDSRPQLVGGQLHLPTVGEAVGQVAEQVGGVGIPVGPVGAVIGRALEVQVAAAQRAGQAYPVVVAVVVLVRGADGEGGVRAQVGFGDPVKHAAFAADVVLEAVAFLVGDHRAAAQGSFAVQRAGNVGLAAIAVPGADAALQGGAEVLGRTLAHHVDRRRRVACALHQSGGAAHHFDAVEHGQVGGGNDVLGIRWKCSSARPSYMMWSTSKAARRVFHPGPARTFATVRPVNPFTASLRSRMPWSSMRWRVTTLTD

SEQ ID NO: 32471 - protein, 168 aa, Pseudomonas aeruginosa
DPLSSVMAAVAGSWVATTLSAPRSTLSPGEMPAPVAAASTQASPPRTSPLSPEPASRRCSASLGSSVPRRAGARRSATAARSKRMRRPLAPCNCSRDAARGWAGRSRAMGAAWAARESEERPSNNALETTCFICSVLDGGAGRPLARPAAFLVYVGNRRRNSRRGKCM

SEQ ID NO: 32472 - protein, 139 aa, Pseudomonas aeruginosa
RPSGFVTPAQMNLLDSGLNRRDVSRHTALHSSHPAHGAQPCRPPSTPSRPSVSAPSALPARSSSTRCAAPSNWAIAPSIPRRSTATRWISAARSPRAAYRVPSCSSPPRSGSTTTPAKSCSPACARVWRNCAPTGWTWS

SEQ ID NO: 32473 - protein, 501 aa, Pseudomonas aeruginosa
SRADHLFRQSLLESVKARLLHPQLQALPLHARIQRAIRQLILDGALAPGNPLPASRALAQSLGVSRDTVEAAYSHLHAEGFIERRVGSGSVVAAATRLSPGRRGAGAPRRGGGAPRLSRRGEAMQAGGGVREQLVPRPFAPGVPETRTFPLATWERLQRQVLKEYGARALTHGDPQGAEPLRQAIADYVNLERGARATADRVLVLTSSQQALGLCASVLLDAGERIFVEDPAYYGARKAFEAAGLECLPVPVDEQGLRPEPILAQPQAARALCLTPSHHYPTGVTLSLERRLALIEWAQRQQAWIIEDDYDSEFHYAGRPTACVQGLDAHERTLYIGTFTKSLFPGLRIGYMVLPPALVAPMTVARSLQDGHNASLAQLTLARFIAGGHFGAYVRGMRNLYGERLGFLAERVGKRLGGLVEPRVPAGGLQMPGLLCAGIDETRAIAAAYRAGVELVGLSALHLAAPPRAGFLMGFAAYTTDELEAAVGVLAKTLRGLRANP

SEQ ID NO: 32474 - protein, 118 aa, Pseudomonas aeruginosa
WASPAMRATTFLDVCCAATWPILRKPPRRCADCSRKAPWMPWSTTPGSPCRKAWRTSTWPLCNRSSTSTCGSPCSLPRPACRGSSVRRRAASSTCAAGRSTAPANAPPTPRRRARWSG

SEQ ID NO: 32475 - protein, 172 aa, Pseudomonas aeruginosa
KPPSRPVIRPIGRLATYARRWPSRSAASSRTAPINAPDSNGTPAERVRRRASCGPARAMKAMGPAAAVAMAVMPTATRTICKRTRSTATPSWAALASPSSSNSRRRPWYSASGTLASRPSAAGTTCDQVRVFSEPASQSWAYIAWSRLPVTSSRLFRPDRLAPTPMPTSTRR

SEQ ID NO: 32476 - protein, 165 aa, Pseudomonas aeruginosa
PPAVAPRRASSTTASAVQRPAASAASEVASGPASNRMICTMAPLAAPVVKPMTSGEPSGLREIDWKIAPAMPSAAPTRQAVSTRGRRTRWTMRWAVGSWPWPSRLANTSAGPSARLPVPSSAAASASPTPARTRQASAARGRQRSDREPRRRAWRPFTGGSGGSA

SEQ ID NO: 32477 - protein, 133 aa, Pseudomonas aeruginosa
CIIDSTYSSHSYPGTSHDPSPARGRRDLAPRRADRFAESLAGHPRGFVQCDRRAQRLRQVDPAGGIVAPVGAGRGPGGAGRQGYPQPAGTGSGAASRPAAAERAGAGWHHGGRAGGARALSAPVVPAPVVAGG

SEQ ID NO: 32478 - protein, 266 aa, Pseudomonas aeruginosa
TTTRCSSARPRSGTSTASRCSAARRPPPRAPTPSPGRSSSTPRTRPSAPRLPTRRRSAATIRGAARSQCPARWRRTSPGAWRWTTRVATPSSTTTTRSSRTAAPTRTSAPSTRAPSCSGCPAEFRAWRASSPSPTTTAIARPRKRRPARSTSSTIARPPCPAGSRTPTPASSTSPMTSTTASACSTRRSTRCPRCTAPPARAARATPTSARRTPPTNRGSASASRRTGSVAWAGSTTPAPAPTRHCTCAGCRPSTTRRRTSVCSAS

SEQ ID NO: 32479 - protein, 472 aa, Pseudomonas aeruginosa
RSRGPSASASRAPSRRPEKPAPRRAGPAPEPIQEIGTMSTPKRLHIGMSLAPTWLSGDAWRRPDSNIEGIFGSDFAVDIARRSEAAHLDFVFRPDVSSLPLDVLETGSGFASLDPTVLLAAVARETSRIGLVSTVSTTFYPPYVVARQLQSLHWISNGRAGWNIVTALQGHENFGLDAMPDAEQRYARAAEFTRLVHDLWDSFPREALLVDRESGRYADVSRVHPVDHDGEFLKVKGPLNLPAFGEARIPLVQAGASESGRDFAASVADLVFAPTPDKEAALELRRDLSRRAERHGRSPRDVRLLPGFSLYLAESREEAREIFMQTHARLDRARKFATIRQMLGLDLSDWPLDRPISAADLPPPVANPGSRTHTDLLRRLIERETLRLDQLLLRPEVVSAAHWQVIGTVDDAVEQIVDWAAAGAMDGFIAAPGGSVGSLRLFLEQVVPRLVEKGLFRERYSATTFAGHLAEE

SEQ ID NO: 32480 - protein, 217 aa, Pseudomonas aeruginosa
ARRPPDPRSSTGPTWAWSVYGSGSCRVPPFQGLAHGCLDIRRVGDVEVFQGVGERHRRMGRGDPADRRAQRGEGPFGDQRGDVGGHRAAWVGFVDHHQAAGLFHAFENAVLVQRAGAAQVQYFAGDALARQAGGGVQRQVDHAAVGHQGDVVAVAEEVRLAEGYAVQLLGYLALHRIEQLVLAEDHRVVVADRLDQQALGVVGRRRADYLEAGDVGP

SEQ ID NO: 32481 - protein, 274 aa, Pseudomonas aeruginosa
RVSLTSISDGPSPARARSMAAPAASWTAKKCEAVDGHPGHAETGGAVGDVVAGHRPVGRGGLGIAVVLGDEQARQVPHRGQVHRLEHRAFVGAAIAEEGHRHRIAAFQLGRQRGAGGQRRAGADDSVGAEHAFLQVGDMHGAALALADPGLLAIDFRHHAVHVYALGDAVAVAAMGGGDAVVVAQVRHHAGGGGFLAGVEVDEAGYLARGELDVQAFLEGADGAHHAVGMEQLVGAQSGHLVVLQVVFTGSSGFAGRPAGDGGRRRRGWPAHRR

SEQ ID NO: 32482 - protein, 178 aa, Pseudomonas aeruginosa
TAAATPRRPPAPTRRARGAARAPAGACCVAGRSPAAPGCWRRGRRRAPRRWLRAAPGRRCWSRWTAPAGGRRRPRRPLPCACRRRRARRSAPRRARPCAAPPGGYPRRSGAAACRGTPGTASGRRGPGGSGWPGARRRRCRSCPAAATHGGCRWRRRRRAGVAPPMPCRCWSAARHGR

SEQ ID NO: 32483 - protein, 243 aa, Pseudomonas aeruginosa
QVDDPPPALRLHQRQFGLAAEEHAAGVDVHHPVPVGEAEFGDLADADHPGIVHRHVEPAELRGDPLDHRPDAVAVADVDPKGQAAATEAADRGGGFLGDLRIEVGHRHVGAGARQGEGDAPADAASGAGHQRDPGRQGEIVGRRSVHASPLIVLVGVCGRALGGADSPPCRRRGWSKADARLRRGGRKARRRAPAWEGRRPPGRRPARQPMSSRTGSRRDAETLRLSRRLWRPGACRGSPMGA

SEQ ID NO: 32484 - protein, 262 aa, Pseudomonas aeruginosa
PASDPADGGAERAGDRERLLHAQRPGPLGAARAPCAGLRRQPAGLPVRLGRRWAPAGVEPGGAALPAAAPGAGAEPHRRGVRPRRPARRRRPGAVPAARPGRRAARASQRAAGQGAAAGARGARRRCARPAHRRKPAPGGAGQGPQPAGADPGRDRRRQGGFRPPDAPGQRPSRQTLRRAQLRGDSRKPDRERAVRLRWRSLYRRGGERDARPAAAGRWRYPVPRRGSVRCRWACRPACCACWPRARWRRWGLRAGRLWISR

SEQ ID NO: 32485 - protein, 162 aa, Pseudomonas aeruginosa
PSSLPAPTMVSAGPCRSSPAPPSASSCCWPSSASGSSARSRPTRASSTTWGWPARRSSLMWATASPPRIHAWPWRKTGSPGSSRACSCNGSIPRPGSPALPAWPCSPARARTRRCWSSWPSTWWSATSRWPPGHCSVTAWRCCSTAPGGCACSIGRWAAPWC

SEQ ID NO: 32486 - protein, 267 aa, Pseudomonas aeruginosa
PAVGAHAEPDPFQPLQVARVFQRRVPGQECRCRHYLARQQEQVTGLQRAVRQVADAEGDVDAVADDVVAAVVACDAEVEVGMLLDEGCQVTGEVAVDKHRGHRDAQAVAGRDGALAELDEALLVEFQHGAGGVQQLRAVLGQRQLAAVAVEQRTAQVPFQPGQVQAGGRGAQAQRLGAAGDGAGLGDLGEYDQVADVVDHAVSRRGGWVHPARWRPAGQAREVESGGASRAFQRRLQKPRRPRLAASRRREVCQLPRARMCWSSALA

SEQ ID NO: 32487 - protein, 166 aa, Pseudomonas aeruginosa
VRSKPSNNGMFSCRPMLRSRSRVSPLNAIAWSLWLRARLALSARLGRPAARLSSTEAAAAFSRAWAASSAGCSRRASASISSMALTKPVSGCASSSPERRSGVSGARPMRRAMTPRALLRAPSSRTWARLAWDSAVCACRRSERAAAPARYLASAASRFCAASSAT

SEQ ID NO: 32488 - protein, 159 aa, Pseudomonas aeruginosa
AATERAVLDDRATWLGAAEHTQPACRWQAVALAEMAGHVALVCETGGKRGFGQRLAAEHQPAGDVQPALDQVAVGAGAEQRAEIARQAPAFALGDLRQFVEAQRALQVRVDVLPGALGGDEVEVAPAARPVAGHGVEGVGQFEQGVLFFQRLQRGIHGL

SEQ ID NO: 32489 - protein, 145 aa, Pseudomonas aeruginosa
QGPAGGDQARVVGQAPAHERQRPAAEGLLDQRRLDVEHPVAEPFLAAGLAVVQLVGMQHQAAARQAVALAAAIAEALHPGQGLADGIGVVAMRIVAVAGEVSLDAFHRTVLRGASNPVAGRIGVAHGERLVARKVQASASLARLE

SEQ ID NO: 32490 - protein, 154 aa, Pseudomonas aeruginosa
SWPQAWRWEAVRLAARSMRRAKSGTGRGFGNIWRKSDDDWLGMDNRPFDCGCSLAAHHSCLEHAMKAEDILSDRQDRIRLGGVEIRKGSVGAFIANARLLLEEELPAAQRRQAEEDLRALLPAIRALGLLELFELRDARLRTLVADWENAAGRS

SEQ ID NO: 32491 - protein, 212 aa, Pseudomonas aeruginosa
RVFFSGIPMAKRGRPCGFDREQALRRALDVFWEAGYEGATMAALKEAMGGICAPSMYAAYGSKEALFRSAVELYLSQECQLSKGAFALPTARESIAALLESAAVSYTTEGKPRGCLVDLSTTNFSPANKGVEDYLRDHRRRAARLLRERFARGVADGDVPAGADLDALTSFYSSVLQGLSIQARDGASRQQLLAIGRCAMAAWDSLLAVEAA

SEQ ID NO: 32492 - protein, 361 aa, Pseudomonas aeruginosa
YRIDPNPGRGPSARVSRPGHRPLPIGAFMTTLADIPLSMLDLVPVRTGGSVAEALHNSLDLARHVERLGFNRFWLAEHHNMDGIASSATALLIGHIAGGTSRIRVGSGGVMLPNHAPLVVAENFGTLETLYPGRIDLGLGRAPGADQATMRALRRDRLGNGDDFPEQVAELEMLLGPRRSQQSLLAVPGEGTQVPIWLLGSSLFSAHLAAQKGLPYAFASHFAPRYLHEALRIYRSNFQPSAVLDKPYAMIGVPLIAAPTDEEAEFLATTAFQRVLALIRGESLKQKPPVESMAPLWLPHEQDAVGSFFGLAVIGGPEKVRARLEILLEQTGADELIFTSDFYEHAHRLRSCEIVAELKGA

SEQ ID NO: 32493 - protein, 255 aa, Pseudomonas aeruginosa
SGACRENDVDLRAVGSFGDRFFGSKLRTKNNKPERNPAMPVAHRLLFSLTALLAATAQAVVDGQKLYTQGGANPAAAACVTCHGADGMGLAAAGFPRLAGLPAAYLSKQLHDLKQGGSREHPVMKGIADALGDDEIQALATTLAAMPAPKLVELSRVATPRSPGETLAVRGAWERNIPECVTCHGPAGSGVGEAFPPLQGQGEMYLSNQLRAWQLGTRRNDPNDLMGHIAKSLSEEEIRSVSQFFATLGQAGGQP

SEQ ID NO: 32494 - protein, 290 aa, Pseudomonas aeruginosa
TWPSILSLAVAGLLVAPVHAATAPSEPFQPPAESSLPDNAFGEMVRQGQALFVETRKNAPHLVGNQLNCVNCHLDQGRRANSAPQWAAYPVYPAFRAKNNKVNTFAERLQGCFQFSMNGKVPAADSPEIKALTVYAYWLASQAPTGVSLPGRGYPDVAPPEGGYSIERGAKVYAAQCAICHGADGQGQMALGQTVFPPLWGAQSFNWGAGMHRINTAASFIKYNMPLGKPGTLSDRDAWDVAAFMNSHERPQDPRLVDGSVEKTRQKFHANDGVNLYGQKVNGVLLGQGI

SEQ ID NO: 32495 - protein, 145 aa, Pseudomonas aeruginosa
GAAGRFRRCPDRGRGRGSARSLARFPPPAPPGCRRRCGARRCPAGCAARRWPAPRGLPAAPRTSRRPASARTSARRRGRRRAWLPGRRPRRCIARRRRTTGCLPPAPAATAGPASGADGRRLPRRGPGPARRRRPRSCARPAGGS

SEQ ID NO: 32496 - protein, 237 aa, Pseudomonas aeruginosa
GAGAGSCVVSVAARRPEAVAEAAHGLHDGVAELAPQVMDVDVEGVALDLVAEAIDAVLELLAAEDPPAVVEQCLQQRLFASRQFHGAAVEPGFAGARIVAEAAVFDDVDATPGGAPLQGMQAGAEFAQVEGLEQVVVGAGLQPGDPVGHRVARGQHQHRQVDALLAQALQQAQAVLVGQAEIEDQHVEARHLEQRLGIGGAGHPVHGQALGVEAGDDAAGDQVVVFGEQYMHGGIAG

SEQ ID NO: 32497 - protein, 501 aa, Pseudomonas aeruginosa
KALSMRVLILLLMLLLPGLSQAQPGDDLFAPRGAMQTDFLPVEKAFRFTWERLDDGQVQLRWQIAPGYYLYQKRLRFDGLDPALQPQLPPGESHSDEFFGESQVYRQSLELTLPAAAAGQLRLGWQGCADAGLCYPPQSQALDLGGTGPAAAGTSGEVAEDQGLAGSLQAGNLAWSLLLFFGLGLLLAFAPCSLPMLPILAGLVVGSGAGPRRGLLLAGSYVLSMALVYAGLGVVAALLGGNLQAWLQQPWLLGSFAALFVFLALPMFGFFELQLPAALRDRLDGLSRGRKGGSLAGAAALGALSGLLVGPCMTAPLAGGLALYRADRQCPAWRPGAVQPGPRHRHAAVAAGDGRQPLPAQARSLDEPGQGRVRLPFPRHRLDTPASAARRGAVDRPWRRVAAGPGLRRAAHGARPGAARGAVRRGGLHLRSLGRGDVAGRRGRGRRPLASATGVCGGEPGRYADGQRPRGVPHGEPAGRAGPSVGCGQGRGTMGAARLLR

SEQ ID NO: 32498 - protein, 368 aa, Pseudomonas aeruginosa
LVRVLPDHGETGVRQARCARRPAGRAPAAARRDRGQRRQPRAAAPLPGTRPAEPDLDRPGRRGAPRAPVDRRSRRRRLPRPLAGDPGARLMLSFSLGPLVVSLQHLLLFLALGAALLGGWLAARGGGRNAEPVLFNLLLLGLLVARLAFVVRYWPQYRGDFAQMLDIRDGGFLAWPGLLAAVLGALFWAWRRPALRRSLGVGASLGLAFWLLGSLGLGVYERGTRLPELSLRNAAGESVQLADFRGRPLVINLWASWCPPCRREMPVLQQAQAENPDVVFLFANQGESAETVRHFLQGENLRLDNLLFDNGGQLGQQVGSVALPTTVFYTAEGRLLGSHLGELSRGSLARYLEAFEPAAAAPATRSSE

SEQ ID NO: 32499 - protein, 576 aa, Pseudomonas aeruginosa
RSASGAGPAERRFRHPHLPSRLRRRSLSAVAADPLPCAGLPRPGLDLVDQSLCRCFGVPARPPFLRRPRSPWRRRRPPGRRQLVRPPAIATAGALLRQLHAVQRRAAAHPPAQAVRSGLRPRRRAPLGSAHRGAGGGTPRQLAGAPRARSAQGFRRTADDPGGRRAVRLSPRRYRATAALGPRSGRRARSRRQPRRCRADQPQRGRLQRLPATPGARLERWLFAPAVRRGAEHLRRRRDAGGRTGPRGPGSGLCHGVHGRLRNHHQHGRQRYAGAAHPSRPARPAAAVPGAGGERGGGTAALRWRGARRRALHPGGGGDRRPADSAWREGLAELPRGEPRPGDVRRPRPPAIAASERQAARGVRPWSALLPGRVPGPARIAMRIARPGASPFRPGLGTDGPALAAQLGVPHPGALADRPGRRRSEDLRVAQDQPAALAAVACAVFVIGVEEQPRLAPAEHQRRADGIDPLAGVRAVVPVDPLVGDLSQAVAGQPDSPMRIQRQRYRVVGVERLARLQVVVGQRRRRVAILARQQVLQASAGFPAFGEFPGQRVVRVEAPVVAAGIDRPMPVVAPGG

SEQ ID NO: 32500 - protein, 165 aa, Pseudomonas aeruginosa
MISRPMKKVAQSSRVPPRSSAPRICRRSEVPSDSSAGSSRRPAQPSGRRPRRSRMRRRRAASGARRARKRTDSGRHAQSSGRLARGRPPPSSSTLSQPSAGTIRAASRPPSAEPRVKPQNIAVTISARCRRGQYSEVRVIALGIAPPRPRPVKKRSRARVSTEPA

SEQ ID NO: 32501 - protein, 290 aa, Pseudomonas aeruginosa
PRAAGSRRPTAWSHRRCWPTSNCCVAATCCPSARRGWSSTLPGSAWWPGWRWRFPARARWACAGATNRTATVPAKTCWPACAKARRPSRAPAGGCYCKKAAASRQCDSLSFMCRPDFPMSAPILLSAHHRAMHALYSEHHGWLQNWLRGKLGCAADAADLAQDTFLRILLKRELREIGMPRAFLRTIARGLVIDHWRREELQRAYLESIAHLPEAQAPSPEARELVLELLEEISRMLEGLKPKVRTAFLLAQCEDLSHRQIAERMGVSQRSVERYVAEALYHCYLLRYGE

SEQ ID NO: 32502 - protein, 168 aa, Pseudomonas aeruginosa
FSSPAARSSSPAAPIRNRPRTGRCGYVPRKGCSRPSAPVSTYACKMPPPVSASARVRCASMPSARVRCRLRWPRRGRAIGSPPTACGASNGRRWTPWPGPMASSSPATCAWPTSSPRSPATATATSAAPRRSPTCACPGSIAWTTPTSCCRCSRGPCRCACSDIPAGG

SEQ ID NO: 32503 - protein, 304 aa, Pseudomonas aeruginosa
PAGRPGGADQQEAVVRGLPPDHRQHRQHGPEGDGLRFQRAARRGEAHRLPPDRSRQGLGHPVRSRQGGALRHRPDPGHRLQRRHHPDPARLPATRSQRGLPRRRTGRRHPVAPQRPAHLPRVLRWRAEQGRLRPHPADVRLPVGAPHRRRLVGAAELPLPGLRRRPVAGLRLRLERQRAEQAEPLLQRRPRAPAGVYRRQHAAGRIRHRRGAPHPAHRPRLPAPAHRGRLAFRLGLGAGRVQPGLRRRRHQLFPGRQPHPPPGADRRLPPGPDRHRPVALLARPAPGLGQRHRQEPQHRQQGRR

SEQ ID NO: 32504 - protein, 82 aa, Pseudomonas aeruginosa
SEFESASKQPRLGGASFCRATSANNQLTRTRPSAAWRPIGPSHYENDDIASILKRPYSQDDAMKAKCHSLLSLFGLAFLLLD

SEQ ID NO: 32505 - protein, 520 aa, Pseudomonas aeruginosa
RYGHPQPAEPVHRPVPGRHPVPQPDRRRGGGAGAGQGRRRQHRPGPGGQRRAHRQYRHAQRRRAVEQPFPRLQRRRQRADPQQRHRQDPGYPARRDHPRQPQPQGPGGAGDPQPGHRRQPQHPGRLHRGGRAVGAGDRRQPARHHLPGLRLHQHAARDPHHRQADHGRPAPGALPGGRRRHRRRRRRTERRQPRTVRPDHPQRQAQRQALREEPQHRHRPQRRPGRQPAGHAARRRWQREATAGDRQLGAGRDVRRGDPPGRHRTGRGGAAGRRHGRQRRRHPHRRQRQAEPGPGLQPGRPEDRGPGRGAERQDLRRWQRRDPQRGGTGQPAEPGGARTHRAGGGAYRQRRGDRSRRRARRAAQRARRPRAAQRHPAQRRQPGGQPRAGSEGEPGTGQPGRQPEGGDRPGRRRTPGQPWRQAARRGRTAGRGEQPGQPPGRPVAEPGPRRGQDSWRSRQPWRPGRRSERTAGPGCRTGQSQCRSPFQQGRHGHRGRSSGQQCGRQAGQRAPYAPEGGSAR

SEQ ID NO: 32506 - protein, 639 aa, Pseudomonas aeruginosa
SACQTRCAGAERGRADDSGRAGPRRRQSRQRRWSASPGNRGVVIDARQVDNRAGEIASQGVATLNLTEQLDNRGGKIVGDSGLGITAPRVLNQDKGVLASRDGLRLSGTELFNGNAGLLSSQRHIEVTLDGVLDNQGKGALLSDGTLTVSAGRIHNQDATLSSAGALRLSSQEAVDNRGGKLVTDSSLRLTSASLDNSRSGIISANAAAEIHTGVLNNSQKGNLGSNDGLGLIATEVDNSQEGRITAKGMIDANIKGLDQQGKGRLVSNAGIILDLNEGTLANGAQGLIATPGTLLLRQLGMVDNSGGEISSDRAFTLTTTALTNQGGRLRSGGVLTLRIAQALDNSLEGVLSGTGGLDIRALALDNRSGSIGSKGAVDIDVSRLENDDGDLLSEGRLKLTAERANSVRGRIAARGDLHASVTAFNQAGGELSSEGALMLEADSLDNRSGGLVSADGNLTVSARRIDNRAGEIASPGQVTLDVAEQLDNRGGKAIGDSGLRLAAPRVLNQDGGVLASRDGLRLNGAELFNGNGGLLSSQQSIDVILDGVLGNQAGSLSSQGRLSVKSGRLDNQGGAVSSAGTLSLSSQGALNNQGAGWSPTPVPSCAAPASTTARAASSAPRGPRRSVLAASTIARRAA

SEQ ID NO: 32507 - protein, 288 aa, Pseudomonas aeruginosa
DRRSATSALLKKRRLCISRVSSVAAGQRPPRRPERRGGARSMSAEIGVAHLLVAEQFFAAAAHADFPGDHHVGAVGELQRMVGVLLDEEDGHAAPGQLAQGLEDLLDHDRRQAQGGLVEQQQLRPAHQRAGDGEHLLLAAGHGHGALVAPLLQAREQLEHALHVLLGVVHADGNGTHQQVFLDAHVGEHPASFRRLRDAVGRHVVRRLLADVLAAIEDLPGRRARLAEDRHQQRRLARAIGTDQAHRLALVDLQRDLFQRLDRPVEHVHLTEFQQRRAHDSSFSSAPR

SEQ ID NO: 32508 - protein, 359 aa, Pseudomonas aeruginosa
ASECSIARLAGSNKRRPALRQASFPPYVIPFIHITRSARSTRARKPAMLNKRRLPSMTALQCFEAVARHLSFTRAAEELSLTQSAMSKQVAQLEEQLQHALFRRVRKRLQLTPAGELYLAEVRRILQQVELSTRFLLSYGGETEVLRVATPPTFGARWLIPQLNGWRHRHPNIHLDLRQELEPDDLRQGHCDLAFFFGPGTLPGAECIRLFGEQLVAVCAPSLLPAGGLDEPTQLAELVLLQNASRAEAWHDWFASLERNCQGCYHGPRFDTFYMCIRAAQAGCGVALLPRFLVEEELAEGKLAIAWPHALPSQEAYYLAYPEHAAEVPKVRHFIEWMVERLEQEQPSAGPRQTRHDPV

SEQ ID NO: 32509 - protein, 260 aa, Pseudomonas aeruginosa
RLWSALRPLTSTPGKAHWPAKGAWARRISNSSSPCPGFRRNATISTLANTSAELIVTPLFSPPGVRRHSSAVRPSLPAGTRPPVPPALHAGAGGSSSCAAAAAPPPPAGRSASTIRRRVRSAAAPPRCRRRSAGRSAVTPGRYARPALPAGRCCRPPDNQASILLRSVRNTPAADRSAGPAAPASGSAARNRPCACRRRGGGSAPGRPVRRKAAPGGSPTHGRGAAGRTPHRRPRGRSRGRVRRSSRQAVGESGNLFHHA

SEQ ID NO: 32510 - protein, 234 aa, Pseudomonas aeruginosa
IMCPHSAPTRQAEASMNRPSKIASFDVDAQKGFTPLCPDELPVPGGDAIGAALNQLASRAALRLGSKDAHSPKAAWVVESAEQMLRPLAYPDADLTWVSHCVPGTPGFELLDELPRPIDYDFFVWKGVEPDLHPYGACYHDLAERRSTGVIEYLRQNGVSHVLVGGLALDYCVKNTALQLRRAGFEVLLYLPACRAIAEDTAQRACDEMRDAGVILCADLERLDSALAGADKEK

SEQ ID NO: 32511 - protein, 322 aa, Pseudomonas aeruginosa
RPATAIRWRRYPTPRARPNAATRTSSPTSATSSTCRPNPFAPNGSPNMQQIQRDIAQALQVQPPFQSEADVQAQIARRIAFIQQCLKDSGLKTLVLGISGGVDSLTAGLLAQRAVEQLREQTGDQAYRFIAVRLPYQVQQDEADAQASLATIRADEEQTVNIGPSVKALAEQLEALEGLEPAKSDFVIGNIKARIRMVAQYAIAGARGGLVIGTDHAAEAVMGFFTKFGDGACDLAPLSGLAKHQVRALARALGAPENLVEKIPTADLEDLRPGHPDEASHGVTYAEIDAFLHGQPLREEAARVIVDTYHKTQHKRELPKAP

SEQ ID NO: 32512 - protein, 266 aa, Pseudomonas aeruginosa
GSPALRRGRCVPDRAPACRVAAPARPASSPRTSARAPAPPPSAGAAGWRTGSPASARRATPATGTFPTARHPRAAGRCRRPGPGRCAAPLRRHRHPRSATAPPAAGARGRRNARHSGRTRTGFPPPATAGRDPRGPGRARRAGAAATARRRPHARPVPRCPCSRRRVASTPPRHPPPRLRGSDRRASPSSGRRRRRRRTRACRWPATAGRRRPRRRARPAPGTTAPGVAPRRPAGARASARRGTPGRHRRGRGRTEVRSAGRERPA

SEQ ID NO: 32513 - protein, 169 aa, Pseudomonas aeruginosa
RPGCPGSARLVPAPSGPGGQEVVPRQCTATVRDRRQGCSRARFAGGRAAPAISAGCSAGATSSCPWRRPSPCSADPCSTAYHRRWRVAAGRYAGSAACRPSCCRPASSSSAERSGIRRYPAGRSGPGGACHCRSGRRAPSAPAPRAAAASLSGRGSAGRPCAGAAAGRS

SEQ ID NO: 32514 - protein, 215 aa, Pseudomonas aeruginosa
AGRAPDRNTRPSTWDSRTAAWRLASRAPGGISRNGGSRKRGARNIAQKMSNSDVFTGYCLSSAGFEKMPSFSHLVSILHSSSSHPASKAGPRESHRAPSSCSARGHLPATGQRRFARRAGVSGASGQRRLVERLAGPARRPRWQPGGGGPRTSGAGRPLRRRRRPHQRRPQPQRLVAAPRPAETRGGIRRLVAGSRQRQPARPAPVPPRRARRVP

SEQ ID NO: 32515 - protein, 229 aa, Pseudomonas aeruginosa
PPGAAGDLGHLRDPLQPEPAAKPAARTLGPSPAERLLPAVPCLPGVQRRRLALAGGRRAGADPAGQPADRHRPGSAALAPGFGHGAPVPGRLRPGARQRQPWRDARHRAGPADLGQRHGLPAGADPGGPAVLPGARLAHPGSEAGKGPGPGPGRPGKERAPGPAAQRPARPGTRRGSPYQRVERGQSPVADARSATAVRRPSRPADRAWQPQAPDGVRRKRPGRRAPPR

SEQ ID NO: 32516 - protein, 308 aa, Pseudomonas aeruginosa
PSPFVEPWRRARRPRKSNRLSTTAKRQIRFPSSNTARYRPTSQPPARRFRAIRPCPSATPAMISGTLHNGPSTAACTSSAGTTTAPSSRITATAGASRKLRNSRPKPPGLYSEACQYRASIRQSRQVTCSEEAMTPVRVGTSATCNLSSSSPDSWDSPRSWVRTLVTSVARAPISSLEVCPSTSANTTPTATLPSSTWLQDVLARRICASVRVPSRTRRMLGSPRYHQNIAGSTAQARTPKASPNPRRSSTRLPAAALSQNNSGTTAEPATASVACMRPRMVNSASARMRSIPYQRSTARSQRPWLSV

SEQ ID NO: 32517 - protein, 164 aa, Pseudomonas aeruginosa
RVLSASPAVPTTHRPRCWSFSRVRARLVTATSGITSAAPQATLRTVALRVADLSLGTITACTPAASAVRRQAPRLCGSVTPSRASSSGTPSLRSSSSSSMFSPQTWLGLTSATTPWWTPSAHSSSSRRSRCPTGIRNPAASSVSTWTRGSCRPSASHNCLTRFG

SEQ ID NO: 32518 - protein, 197 aa, Pseudomonas aeruginosa
LMTWPYVCAPRWRPERCRPSAWKAPCDAWSACPAWRQRRACRPWPCPSRSCPQERPCPSSRPCPCRRHAPRRAAPASPRDSCARRCCRASPRPAPAAPARPAAAPAPCRPCAAAPPRRRDWPAPAPGRPRARMRPCAPSAPCRRSPTCRRCASCVRSARSARFRPARNRSSARPGRPAPLPLPWCRRDGSCARCVRR

SEQ ID NO: 32519 - protein, 116 aa, Pseudomonas aeruginosa
PWCRSGGHGSGSPLRRTGSRSACQPWTGSSRRPWPAGRPADSASRDHWTAPPAASGSPARGNTPSCRAWPPLRPAPNRPSRSARHRRSPRTGASRRRAWPRRTPRRRSRGHPRRRW

SEQ ID NO: 32520 - protein, 137 aa, Pseudomonas aeruginosa
AWPLPSPPRPARRGGYRSCAGRLRSPSPAPCSHRAPRRSRPGPGGGCSAIARCAPGRTGCAWPCRPCPAGSGLPAGSSGCPRPPRRCRFPRSSGRPRSRGPARSPRPAGLRGVRAGHGRTPGPGRGRRRTPGASGWD

SEQ ID NO: 32521 - protein, 640 aa, Pseudomonas aeruginosa
KRAACAARSVIAPLSASGEWMAQDDGLVAVRTGGDDIDRRTHQLFHALDVCAGVGRQLFQGLRTHGRLAPAGHFLVDRLQADVSVGIGRRFQHIAIGILVADAQAHHIQAIEHVELGQAQAGDAVDLDGAAQDHGIEPAAATSATGGGAELVAALGQVGADVVEQLGRERTGADASGIGLGDTQYVVQVQRAEAGTGGGTASGGVGTGHVGVGAMVDVQQRSLGAFEHDVLAVLAQVVQGRSDIGHHRLEQLGILHRLVQGLLEVDGRLLVVVLQDEVMVVQQLAQLGGEALAVEQVADAQAATCHLVLVCRADATTGGADLGFAAGLLARLVEGDVIGQDQRTGRTDAQALAHRHALLFQLGDFAQQRIRRQHHAIADQALHAFAQDARWNQVQDGFLAIDHQGVASVVTTLVANYGSRLLGEQVDDLALALITPLGAQDYDILTHNTCPHRGSSMPAAAGGISGRQRRHLPIAIAQRQLPVAARLARRSRILPGQSLDDTLPVAAQSLHRLPEPGPFGRRPDTRYSLVQPGLAESDQAFQIGGETGGRAGAPEIGTDIIIATALGDGLANAGHEGRKHHAGVIVIATQLAEVEIQRQAGEAPGQRIGDLDQLVQRHLDIGRRRRQTGTALLQRIAAAT

SEQ ID NO: 32522 - protein, 357 aa, Pseudomonas aeruginosa
HDFSGGRCRPPENRVLLVGLVQIAEELAARIEHQYVALLGEAFAIRLQATVEGIELRILVVGLGVDRGSLGVAVTAGLFRLAVGFGNDYPALAIGVGTNAFGQFATLGAVLAGLALTLGAHPLEDAAVDFLRQVDGLDPHVDHLDTQLLLRHAVQRSGDVAHQRVALARYHFMQGTLAELVAQTRFETPRQAFVGDLLEARGSGVEALGIRHPPLGIGIHHHRFLFQGQEALGRGIQGQQASVELAHLVDVRDLEVQARLDVGLDHPAEAQHDRALGLLDYVDAVPQDDGGDDTDDQSDQRLVAHQRLSLVRASCWRRSLTIRDPRSEALALPPPAEAPAPVAGAALRPSIILSSGR

SEQ ID NO: 32523 - protein, 402 aa, Pseudomonas aeruginosa
QVNLVIDLEHRQFVGADLAEHRQHLLDLRIPFGLVGVDHVQQEVGVARLFQRSAEGLHQLVRQVADEAHRVGQHHRPEIVQLQATQGGVEGGEQLVGGIHLGGGERIEQGRFAGVGIADQGDRRDIRALAPASSLLALAADLLQALLDLADAHAQQASVGFQLGLARTAQTDTAFLPFEVGPAAYQPRAHVLQLRQFHLQLAFVGTCALGEDVEDQPGPVEYAALERTLEVALLAGRQGVVENHQLDVFGLDQVVQLLDLATADKIFGARLVAGDADECHRFRAGRTHQLLELLRVFTRLGVLPFQMHQNSLFPTTWALKEQSGLPSSVARLGRLVTARQTHRTARYHGGDRVLVNHLADGVLQQDDKLVEGLDLALQLDAVDQIDGNRDAFFPQGIEVRVL

SEQ ID NO: 32524 - protein, 145 aa, Pseudomonas aeruginosa
AAPGRNPAAGCPGRSRATRLAPRPRVTARSRPCRRHRPRPERAAPPAGYRRNSRRSRRRPMSRHSSPPVPPDSPARSRPGASRPAGRTRRRQRRSDAARSGWSPRAARAGRRDGPRPAHDAGCHRGSHGPSGCHGSELRAWSGAR

SEQ ID NO: 32525 - protein, 696 aa, Pseudomonas aeruginosa
CRPARPPHQCAGNRRQGCFPGVPWPPRRDARPPHRRRSGSPAADSAAGYAVLHSSLGRQGGARDGQGLADFQVVAGQAVAATQRGHAHFIALGDHRQGLSGPHHVLARPHGELALGAQRGDVGTGRRALLEILADAAGDRTRQGLLMAGAGQLARLVDVRDEAGFHQDRRDVGRLQHHEPGLLDTTLVQRSDAADIGQYLVADIQARREGGGHRQVEQHAGEHLVLVAEADAAIAADQVGTVLAVGQPARGFRSGAAVGQGEHRGTEGAAARRGVGMDRDEQVGALLAGDLGALAQRDEIVAGTGQLGPVTAHLVDLALQLASDRQGDVLLVQPARAKGARVFTAVAGVDGDDDIAGAALGWQRQLGHRLGRRHRGDRHARGRRRGYVRGQVGALVVEIDHQAVAVLLVGRQDEAFRGDLRRQVEDHAQVVGRALGGAHRGDRGVAELETVELGRQLGAADVDDDTVGRGQGEQAVLHRTGEIEDQTGVVRSAPDPHALDLRGGQNLADLAGQQNHHPSQQRPQTQAPTHRFSHAPMVRVAHQASPPRTVRYQAQCPSTRLGSNGNVQIGGWQNARTALGPLDQTECAAVEIVADAEELQFLRIGEPVQVEMVGAQLADFVRLDQGKGRAFHRAGMAEAAQDAAREGGLAGAEVAMQVDHPLPPAGPGDAPAQFEHRVFPFGGQDHFRHGLHSSSN

SEQ ID NO: 32526 - protein, 332 aa, Pseudomonas aeruginosa
RHASSSAAAGRSACTSAVERPNRRAASPGCGVRIHVRGPAPTGSRASRFNASASQTCGNGRDRTALSRATPPGRAGQDRDRATARWRVRQGPSSWFADATPWAMTSGQRLNNARHMFDRGSPPRPARAPQRRGAFRRPVARPRPCRCRRRPPAGGRTAPCVRSAAALPASAGAFRARRRARGWSACSTTASLPSSSNTSSPTRAGASPVNSPIFRPMKVTVRSALIASPNTAPVSALKPEGISTASTGRSAALARRMACAKGSRTAPARPVPSNASTTTPSSTAHSLQGSTTTPVASAAACACAASPASRCGAATASTRTRQPARCASAAIR

SEQ ID NO: 32527 - protein, 110 aa, Pseudomonas aeruginosa
SASVCNNWPSASRPKSARSVSAPSSTARRCWKRPSPNRPASAGSARTRWCSTARPAATSSSASCSSTCRYPSTRRWTASIADAARPAWTSARPRPSSAPTGWTRDAASPT

SEQ ID NO: 32528 - protein, 302 aa, Pseudomonas aeruginosa
RLTRLTMIGWLLSIYRQCLHSAAAHGLLELGEGRPMGGQQHLAAELDGQRRRHAGSGSDQAGLDRLEQVQLFLGIVLQGARQRADEAVGGENPEEGAHQGGGDVVADLRLAAFAKQRHGDDDAEYRGDDTEARQGVGDLGHRVGRMLQVLLETGQLHVEQAFQLVRRHVAGGHDAQVVADIGGHPLILQHTGVLAEDGAGRGVFDVRLDRHHPFAPALVEDLVEHAQHLEVVGLGEAVAEHLRRFLQHHHERAARVGLEERPQCRATDDQDLEGLDDGADLAAGEQEAPEDTGENDDDADDF

SEQ ID NO: 32529 - protein, 401 aa, Pseudomonas aeruginosa
CWSWPTSAASRSATCMPRPSPRPPSAPSARSSSSAASAARNEGHARHTGRARFPLNCCPSSTRGYSHVRLLRPAIGDRAQRPRAAPGRARADPGRPDQCRPLRRRAYPRRAFRRPQTHPVGTTPGTRPATGEGRPGSPVRRAGPPPGGDLRGLRRRRRRLGGPLHLAAGRDRPPPLPLSQRRPAGLDRRRPGARPRGPGACRRPAAADVARRAQCDPRIPAKPPRRRRPGGMGCAQPQRIRRYQGARREGRACARRDQFRMDRRHGPGSRPAHPRGYRRSPGGPRHHAGQGSDHPLPDPPSLRLHLPGGQGAGLPAGQRLRRLLVGMGQPPRYPCRGLRNVVQRSSVHLQPVPAAAPPAVPADRLRRRLPGDLVQGPPDRLVRPALPGRYARSAGRGPAGL

SEQ ID NO: 32530 - protein, 325 aa, Pseudomonas aeruginosa
RSRLSPHGKPEPPPLVARPHSDAAEPELLRRHPEGHQVLAGAPAQGQPRGDRAPALPGPDRTQPVGAARRGPPATARTVPSRGAFRLRPPGTALPQPGHRPRRTAAQDRQPLPGPAEPPGHRLQADRGPGSAAQQPRPRAAARGRHPAGDPQPVRAADPRQPVVLPGPRGALAGTPPALPVGQPARRASSRGARRTGQAHPRPERRAGLPDSAAARLRALQPDAPEQHCTARRGARTLEPAAVDTERDAARLTVHRRAADRRPAALPFAVPGDPTGQCPGHRHPAAGRADPRIPAAARGRTRESTPAADRRGDPGPAATSLLGLG

SEQ ID NO: 32531 - protein, 577 aa, Pseudomonas aeruginosa
LRPGGVDAHRILVRASRRGGMKAVAGFVGKAGGVDVVALGATHPAFVREHHGHRFGGHQLGFRQRAGLGAGDDRRTAVVAVGLGVLDQLLAHQLLQLGLAAEQGLQALLLLQQLFLLAADLHLFQARQLAQAGVEDIVGLHLAEFEALHQHRLGLVLGADDVDHLVEVEEGDQQAIQQMQAALDLVQAELQASTHGADAELQPLREQLAQVLDLRLAVEADDVQVDPVAGFQVGGGEQMGHQLFDIDPVRTRDDDDAGRVLVVRLVAQVGHHRQLLGLHLPGDLFQHLGTGHLVRQGVDDDVAVLDAVHRAHAHRTAAGLVDLLQVGARGDDLGFGGEVRARHVFAQFGDRRARLVEQAHAGRRDFPQVVRRHVGGHAHRDAGGAVEQQVGQAGRQHGRLVQGAVEVRYPVHGTLAQFAEQHLGIARQARLGITHGGEGLGIVRRPPVALAVHQRIAIGERLRHQHHGLVAGRVAVRVELAEHVADGARRLLVLGIGIQPQFAHGVDDASLHRFQAVADMRQGAVHDHVHGIVQIGLLGELGQRPAFDPFQAQIEGFAHAYLTEKCFGAAPGCRRAG

SEQ ID NO: 32532 - protein, 443 aa, Pseudomonas aeruginosa
SVPAADRAPVASLVPQPAAGGRGEAQDEGPHVAIGARMVAIVDAQPGALVVQRQGFRDAIRQLVATLRRQDRRGERPAALDLGLGQVAATDLMRQALQGEQLAAVEGEVGEILRQLARAAQFRRRLDLAALGEQYAAALAAPGTVVAVGHQQAAALALGSQPEALALGVDGDPFEQRVEIHQHAAGPRLRQQAGRQAQPVRRAAHRQLQDRRVRLADQVAIAGGIAGDAFEVEVAAAHQATEPDPRAHAPGQPAVRRGRSDETLGLGLPGLVGAFGRGLQAIQAVIVAVGNRPQRAATPGQPGEVAAAHALHRMFGDEAQGCRNRWLWRRLGRLDQAPEQAEDGQQAAHQTSTSARLPLLSSQDLRSPARFLASSMSMISRVPVASSRVSWTSRRVFGSMVVSRSCNGFISPRPLKRVTCGLPRFFSAARRSRMPSRSASSRA

SEQ ID NO: 32533 - protein, 214 aa, Pseudomonas aeruginosa
RSWARSLAPGSTPMATAMSWTSWLASTSPPSTSQVFRIFPRSGMIAWNSLSRACFAEPPAESPSTRNSSARIGSCPAQSASLPGSAGPWVIFLRSTFLPALRRRPALLIASSASCRPISACSLSHRLKASFTTPETNAAASRDDRRSLVCPENCGSCIFIERTKAIRSQTSSGASLTPRGNRLRNSQNSRMASSRPWRRPFTWVPPWAVGIRLT

SEQ ID NO: 32534 - protein, 241 aa, Pseudomonas aeruginosa
SRCCRGRTARRWTARPAGAAGRAGGRTPGECAPTAGNAPADRVPAGRTAPAGCAGRWGPSSRCRSAPGGDGRKPAGSVRRRCRWHAAAGRAGRPRDSPAPRRECSSRATPRASCRRRRPAPAGRCPRSPAASARVRRGYRRTSATARPAARSTCGSVCRNPGCRPGRRRRWRGSGRSAVAPGRPARPPFPGYGRCPCRAGARRPRRTGGCPKAAPAVRRRRWRECSNGVTRGRLLKARRPR

SEQ ID NO: 32535 - protein, 729 aa, Pseudomonas aeruginosa
TASSSRTCSPAAADASDTPKPLAAARGPVARRGLHLPVDHRSFVLEARRLLLEAGLDGLALVGQAVFLGVVANLLGDLHRAELRSAHGAEVRDLGRVLRQGLVMERPRGVRVQAEVELILPTELEARLGQRVVADLRARVALGEVGGMGGDLVGDDPGLHVILVRQTQVLLGRDVAEHGAAEPADHRRADAGGDVVVAGGDVGGQRAEGIERRLVAALQLLVHVFLDQLHRHVAGAFDHHLHVVLPGDLGQLAEGFQLAELGGVVGVGHRARTQAIAQREADVIGLHDFADLFEMRVEEVLLVVRQAPLGHDRAAAGNDAGDPLGGQRHIAQQHAGVDGEVVDALLGLFDQGVAEDFPGQVLGDAVDLLQRLVDRYGADRYRAVAQDPLAGFMDVLAGGQVHHRVGAPADTPGELLHFFLDRGAQRAVADVAVDLHQEVAADDHRLKLGVVDVRRNDRAAAGDFLADELGGDFLRDVGTEAVPRVLLVEQAGGPGFLQLHVLADGNVFHLRGDDAFLRVVHLRDVGARLGPARRAHVGEAQGVEAGVGQAGLAELGGQAGEDLGVAALVDPARTHVRQALAQVDADLRVGIRAGGVVDEHRRVFFAAEGGGGVGEGDFPHRDADVRARAGQVDLARVRERLRRLAVELLKAGDVVLLRCAHRWLSWVIVGRTWHAGPPGLVARRTRRQGRHGADILFPTRVAAVRARRNRTLARSGSTGSGTIRSQPLV

SEQ ID NO: 32536 - protein, 103 aa, Pseudomonas aeruginosa
SASTRKPSTTTPTSPPPRPTTWRARKWCPRPAPACCRNSAPAPASETPGSHSTSVRRPSSATARSSRPPSASRCSAPTAGSSGRPPRKPATRPGWNSPRPSRT

SEQ ID NO: 32537 - protein, 158 aa, Pseudomonas aeruginosa
KSLNLRGSISTRISSPDSGRRSRQKSVSAISVPTASTRSASAIISQPGATHRLAPALSGASGGCRPLPATLVNSGAARRSLSAASASPAASAPPPAMSIGRRAAARRSAAARNASVHGTPRPGRRATAALQSWATGAASTSSGIEICTGRGRSLSNTA

SEQ ID NO: 32538 - protein, 205 aa, Pseudomonas aeruginosa
ARGPRRSPTPRSSGRSPARLSATPCRLRGRTPGRSSALPDAGRWQSPAARRAARPSARRCPAAPGCPPMPYRPPAANGRSSTGCRRSCHSASAPRRPAPPADRHVPPAIARRRAGSRASRSSSGRAAPFRRRRPAAGVARPGPVRRFRRSRRHSRSPRRRLWRRARRPRRGSVRGWWRRTPRPGRTAGRRRWPRRVRLRVRRAAD

SEQ ID NO: 32539 - protein, 394 aa, Pseudomonas aeruginosa
RPCGRRKATRHAIRRKAAKARASRLLQLRTNQPGENENARRMRRASGPANGRSAGPSQGGVAQSLRLPATNHVIGQVAGGDEAEAPVQGRPLGGIEGEEDEQRAAHGDAGQRHQREQRRGIFQSGDRAAAGHVLAAEAVLGVGDDDPGDGAGHPAHRHQHHEQGVGGDHAGQQREQGEAQGDQQRVERYAARAELRQAARGHAGPGHRPEDPRRGVQARVAYREDGGEDDEVHQVRRVGNPDHVEHLHERAFHQPGLLPGNDGGKHDDGQHVEDQYAEHHVAHRPRDALLRSLGLAGGDAHDLATLEGIDHRHHHREHRRQAVGEQPLADQVGEHRRRRTALQFDTAEDHQPPDHDEHQDRRHLDPGEPVLGLAEGAGRQGIEREQHDHEETRP

SEQ ID NO: 32540 - protein, 159 aa, Pseudomonas aeruginosa
PHGHLREPAGHEHPGRGEFQAYRGGPAHPVDPADHEASRRADETRRVGLERTGDRHLHRQLAEADHHQVHQHPGHQVGQHRAGRAALVDGHAGAHEQAGADHPAEGQHEDVAARQGPGELQPFLAVSHGAPPDEGTHRGLRDGSLFLSPLCQRPCLAHG

SEQ ID NO: 32541 - protein, 757 aa, Pseudomonas aeruginosa
VGFAEEAGAAQGFGAVAAQATQACAPGSRVDPGRAQGLALQLAQAGAERHQAHGVAASGQAMGDVRRLGQVRLVQGFGQQRQLLVQASQQVAQQSGELVPPQQAAVGLEHLPVQRGLHRKRRHAGADLAQRAAQLVHPQGLAEHALHARGEVPTHHVRLDAGGEGEDRRGAVQAVELPANPGAKLEASHPRQVHVQQDQVEAPLPAQRQGRPRVLGQHHPVAVPLKQALGHLAVERHVLHQQHLQRRHRCRRRRRAGQARQRQLDLEPERAALADPAFHADPSPQRFHQPLADRQAQAGSAVTAGHGVAALGEAFEDAFAHFLGNADSIVRDAQPQALASCAARQPLDANAHLAGLGELHRVAQQVGQHLAQELLGAAMAVMNLWVQPQVQPRGVLPRPRFEQGEDVLEQASQGKVHRFRHIRRFLQPGEVEDLVEDRQQSLPRCRQCPQALAVTLAERCLAQQLGHAQDAVQRGTDLMAHGREETALRPVGGFRLVLRPTQAGGASLDLSAQLVAIGIAPAAVGAQSLAHVFQGGGDGVDLIALAVHLVQSQRLLQVAFGDMPGELGHAPQMASDQAVEQPTEGHRQAAKETAHPQEAGQAAGNQPAIDRRQVDGDLQLAQLPTLAPRRLVAQGKALDPQHAAWTLVALQQVEVGALQADTGDVGEIPEAAQLHVQLLLVEIPQAALEAGQVAAADQFQARLDLAHFAAVFEEQLHGAGEDGETQAEQQHPPQQAPRQHSAVAAHQASARLPARRR

SEQ ID NO: 32542 - protein, 666 aa, Pseudomonas aeruginosa
IHILFLKRAARTTRRTPTVNFPHLFSPLEIRGKRLKNRIMSSGHDTSMPTDNLVNEPLVAYHRARARGGAGLIVMQVAGVHDSARYTSHVLMATDDACIPGYRRVAEACHAEGCVVLSQIFHPGREIMESADGLLAVAYSASASPNERFRVMPRELDQPLIDEIVAGYAAAARRLHEAGLDGVEVVASHGYLPAQFLNPRVNRRKDGYNGDLDARLRFLREVLAAVRAATSEDFIVGLRLSADERDPEGLSESESLQAAEAVQGELDYLHIVAGTSASLGGAIHIVPPMAIEPAYLAREASTFKARLAIPLFVTGRINQPQEAEAILARGQADVCGMTRALICDPQMPNKAEAGRSDDVRACIACNQACIGHFHRGYPISCIQHPETGRELTYATPNPPSRRKRVLVAGGGPAGMKAAAVAAQRGHEVVLCEAGAQLGGQVNLAQLLPRRAEFGGASTNLQREMQLAGVEVRRNTPVDRALVERERPDLVIVATGAEPYWPPFERGGELQVVDAWQVLRGEVRVGRSVLVTDWRGDWIGPGIAEKLVREGHQVRLAVNGTHCGESLPLYVRDQLAGELHRLGIPVTPYARLYGCDDTTVYMQHSASGEAMLFEEVDTLVLCQGHQPVDRLADSLHGLAEVLRIGDCLAPRTAEEAIYEGLKAAWSI

SEQ ID NO: 32543 - protein, 153 aa, Pseudomonas aeruginosa
RNSSSPMVSPSSTWVARATGSPPERRTVAKPSRRHSSWTPAKRSGWRGTRISNASGRVSSRRRWAARTISSSPAWVLAAIHSGRAVASHSSRRAAAASGSCGSMRRSNLIEPVTLTHSGRAPRRRKRSASASVCTAIQDSSASIGRVSPAKRA

SEQ ID NO: 32544 - protein, 260 aa, Pseudomonas aeruginosa
PPIRPATASRSGTSAATSPKPMAWPATKPRRSPKRVANWQSCCPGSTSARRSGPPCGWIAPSRHSPTCCARTTPSSPNRDACWSAGRPSWRWPLTSPTGSAPAWKKTASAPANMPRCRNCRVRRSPNRPGRWPSHDQGYPPRPAPPAGRHRPGRFAAGPGHRQVRPRPGSEVPFRLHHPRRPRSRRPAGPGPRPRHQPDRHRPGLRPQRGTPRPAAARPARTLGDRQQGRRRVRRRPVSLRLLRRAYPALRRAQPEAPGD

SEQ ID NO: 32545 - protein, 321 aa, Pseudomonas aeruginosa
HPRCIPLPCSSRTSRILPAALASGGRCIEREPPSRPGAMTRQGAPYAPYARPQGSVRLQDPAAAGGGLPGRAGLPGPRPAAELPADARTPPPHGGSRPAALRRRAGQPGGLGALDPELAGPRLLGAGPSAPAGPRRYRAQADLRLRTGPRTEPAAAHGDPGSRRGMPGGDRRRLARRALRRHLAADALPGFAALPGEQPLRPHPAVRRRPSGASRQPALAGAPTRLRTPAHGLAATGLRHAPGAAARCARAEPLPCRRAARERSAGGASGPSAPRSLPAAAGPGAPHRRPVHPAQGPVAPCGHPRPVVGRELCRTGRLAGA

SEQ ID NO: 32546 - protein, 166 aa, Pseudomonas aeruginosa
RMSKQPLVKTIFSPWARASSIASSNCSRPSTPRSEPCSRCTARRSSGALIAAVPSLPTTMPAARLARPTADGSSSPAASAAARVEMTVSPAPVTSNTSRARAGRCRAGWPSRSRVMPCSPRVTSKAPRSSSLISAWPLATSSASSAQRPTMVSNSDRFGVIRLAPR

SEQ ID NO: 32547 - protein, 609 aa, Pseudomonas aeruginosa
RSSITSPTTNTGAWSKRGMDNFMGTPNNLSGQTPSLSADRRRRLLIQSHRVQPRIMAVLRQQLGVAAALDDLPLVHHQDQVGLLDGRQAVGDHQGGAPLHHFVQRRLDMPLRLGVQRRGRLVEDQQGRVLEQRPGDRQTLALAAGKQHAILADLGVEALRQVVDEFLGVGSLRRPLDFLARRASQVAVGDVVGDAVVEQRDLLGHQGDVAAQVTQAIILDLNAIKHDLAVIVLIKARNQVGQGRLAATGTADQGDHLPGLGDETDVIQHLLVGSGITEAQVAHFQAPADPLLLDGTLVFLRRFVELLEDALGAGDAALDRGTDLGKLADRLGQQARRGDIGHQVAGRGVPAQPQHEEHQYRHGDVDHQLQHRRVDRAGLGHPQLLVGIALAGVEEALLFIGFAAEAAHYPVALDGFRGDVGDVAHGHLDLLALLAELAAGGSHHHRDDRQDRQHHQGQLPVHPQQVEEQEDHGQALTDHHLDGIRGRSGDHGHVEGDARDQVAGAVRVEIAVRQHQQLVEQGDPQVMHQPQGNLGEEEVAEERAQPLPGSDQDDQQRHRVDQVQVAQPGPLHIRKQCRVRIGEAVDEILEDARQHRLGRGEDQETDDAE

SEQ ID NO: 32548 - protein, 67 aa, Pseudomonas aeruginosa
STSPTLRVQRSALSAAQRIRNFKHLLRYEQDRTWFLDDSEHLVLKAYLRSSQVHWTLEQLLKQLQLD

SEQ ID NO: 32549 - protein, 601 aa, Pseudomonas aeruginosa
GMRFFACLSRTKRSSSTAATSLPSMYRAADGSWLTAPDRPRTVNATVEPLQSSSRLRSGTDNRGFRLTRRPPQAVVVACRSSPGGVAEAGNPLLQQPVEAAVLRPVAQEARTVAGVGAGKGRLAVMLAHRVQVDQRPFAALFMGLPEQVVSLQVAVADAFADQRRKQPIQCRQLGFRWRNGAIGHVQARLKTSDYILTAEIIGNQVGAPAQPAPAPLQHRQRTGGGDAEEFQAVAFAPGGPGPARPPEALQPMDPALDVVALDDQRAAVRFDPGDGGRAAVLVDVAGGDQAVRVRQQGRHRLGLAAASGEQAERTAHDAEQATVATDLPQQVAHPPAANLGDFLLQGFQRQRMLAVGQQVMHQQLLQERIEERRQLGEEHPEVFQHFLSRQRLAGSFRTHAATVDEIQAAGVAQQVVHVQVVLPEALCMQLANGCQGFAEHRLLGIAQRRLGLHRTPGVTEALRRVEVVEQQPAALALLQPVGQQRRGGQPLGREQTRPFQFALEMPCGLAAHQQLGQHLAPTPFAGTDVALPGQHPQQTVQAQFGSASAIRQGHPQWQLRVAPGGLQFGQSHRRDSLRRRRWSRRRYHCSTSAESRGSST

SEQ ID NO: 32550 - protein, 390 aa, Pseudomonas aeruginosa
PAVPSSGDLGRVADQPLQGLQYQARRQLAEAIVVAEATGALEARAALETEADDLHPVRQRRGELRRGGAIDAHQRAIQRGRHVHQAGIVGHHRASAGHQVDGLGQRSLPGKIEGLLAQPRNQALANLLSTGMVVLRAEQPDLPAGTDLRLGDRGVVFRRPALGLAELGAGTERQHRAVQAQGELVERRLAATVVDPQARLRIGLRQLHARLEGQGHEAFDHQRIALLVELADVIEQPVAHLAAPAGALRYSGEPGHQRRLQRVGQQDRLLVLTAQAASDPAPCGDVHHPVAEREAQGLAHLGHALEDRSAPLGRQHVDHALGMPLAQTLEQGLRHHHVPHPGGTYDQNSHSGSGNDQGGFRLPVTPFFGAYLTRVRHSAWASVLPLTRSK

SEQ ID NO: 32551 - protein, 926 aa, Pseudomonas aeruginosa
NRILHHKFDIDDTTGIVLEIEGCRGLEGIRGGTGGGRAGSQVVAHLGAHFADFGAQRVEIARPRQHLGTYRLEARLHPPATGQHPGADQRLVLPGPGLLLLVALEGAQRTHQQAGRAARTQAHVDLVEGAGWRLRGEEMDDLLPQAGKELRAIDGFAAIGLALGVAVMDEHQVEVRAMAELQPADLAVADDDEVRIARRAVGAQRPAVTLHQLPPGQFEDLDEDRLGQPGQVVADLHQRQRAGDLRGRHPQPVGQLEVTKGLHLLLEVVLGNPHQPFAQLGGQLGGLWRTEQAPLVEQLVEQNREPRDLLGNHRAGRAEGQQALQRAGVLGQQHQVGGTPRHRFHQRQDPLQHQVRLGVFHGHRQQARNEGIQALPAETLHRSYLGAVAQIAETLPGRLGIDEAGVGQLPAGRLLVQRLLPQRDPLGADAAAGRLAAFVLVRVGDHLAEVPVDARPPVAQALVECGPTGEAHDEGHADAVVFVAGQHLRLPVGQRLDGMLGVAQELVAAAQLLDHRRRQVALPLQGRQHLQQRPLLQAQVAPAMDQLEGLGDELHLADTAFAQLDVFRHPLAPDLLLDQLLHGAQRLDGGKVQVAPIDERPQHAEQLLACLLVAADHPRLDHRVALPVTPLVLVVLLQRGEAVDQRSAGAVGTQAHVDAEDEAVDGDRIQRLDQLLPQAGEELLVVQRTLRPLGLAALRVTEDQVDVRRQVELHRAQLAHAEDHHPLRFAGAPADRRAELLALAPMEPLASQVDAGVGQGRQVATGFRQRGAAGQVAPDDAQLLACAETSQAPTEFVLVGAILQPRLQLAAQFAGRVGVLQLAAFGQIQQHRRVAHCLLGDEIAGRGDPSEILQALLGPGLQAGQGGGIEGGDSGAEGSPGAFGGGQQGGRQIRQRRQAHGLSCLGFRPKTTGSTHNVEKALHRAL

SEQ ID NO: 32552 - protein, 88 aa, Pseudomonas aeruginosa
CGRTSTTRTWAATSPPSPPRRPSTTSASTISSRLPPTNTAATWCSSRATRPPASTPGPSSKAASARNNWRTSARKWTATACPPIRTPG

SEQ ID NO: 32553 - protein, 154 aa, Pseudomonas aeruginosa
SSSSTATCSASTARSAATPRSSRNWKACSAAPSGTSTRSSGVASGTRCSPRTPPACCSSAWTRSSTANTRTTRRKTAPTCASTSSARVRNCWKWSRTFPTRKSGSSTAAATTPTRSMRPTTRRSTTRASRPSSWPRPSRATAPAAAKRRTSRTT

SEQ ID NO: 32554 - protein, 672 aa, Pseudomonas aeruginosa
PSTAATSTSTRSPRASTPAATPPTSRRYTAGAPSTPTTAQRDPRTQELYKDYLKPLGVNALLDATIRIGGEVVGVLCLEHAGENRMWQSDEIAFAGELADQYAQVLMNHERRNVSSALHLFQRAVEQSASAFLLIDRDGVVEYVNPSFTSITQYSADEVRNRRLSELPALENLSELLFDARSALTQQNSWQGEFRSRRKNHEPYWGQLSLSKVYDDLGELTHYIGIYEDITQNKLAQQHIEKLAYRDNLTGLANRHYFIGALEERLESSGDRPLSLLLVDIDNFKRINDSLGHQTGDKLLVSLARRLRSCLGDGATLARFASNEFAVLLDDTAVEKGESIAAQVLHMLDKPLFVDNQLINITGSIGLASAPQHGCDPQTLMKYAGLALHKAKANGKHQVQVFTEALTAEASYKLFVESNLRRALAQNELAVHYQPKLCLRSGQLLGLEALLRWQHPEKGMIRPDRFISVAEETGLIVPIGKWVIREACRQARELAEAGLGELQIAINLSPKQFTDPDLVGSIAAILHEENIPASQLELELTESLLLDATDDTRQQLERLKSLGLTLAMDDFGTGYSSLSYLKKFPIDVIKIDRSFIKDIPDSQDDMEITSAVIAMAHNLKLKVVAEGVESAEQLAFLRRNRCDIGQGYLFDRPIPSDLLNTSLLRYPCRTLH

SEQ ID NO: 32555 - protein, 246 aa, Pseudomonas aeruginosa
SPRPPPPARKGCTLCAHPRVIRLPPEQETRAMVLRSEILTKKSELPTPDQALPGRESAMPVPEAHFVNGRPLTAPFPAGLQQVLFGMGCFWGAERRLWQQPGVWVTAVGYAGGYTPNPTYDEVCSGLTGHSEVVLVVYNPQETSFEQLLKVFWEAHDPTQGMRQGGDIGTQYRSVIYTFDAAQKAAALASRESFQAELAKAGYDRITTEIADVPPFYYAEAYHQQYLAKNPNGYCGLGGTGVCLPA

SEQ ID NO: 32556 - protein, 253 aa, Pseudomonas aeruginosa
RLFRHQPVETPAALALGHDLGQPGQQVAQFVFQRPRRIDDGQPGAVETLGVVDRMHVQLGTQQLRRDATFQGLVETLELALVLDRIPDHHHRLAHPPDRLVERSDTTLQFVGLLERRIDQQHRALFRRRQERPRQQPTVALVHGDPPFASHVGLEQAAVLGMQFVEQHAVLGAGQAPRQFRRARVVAQGAVRIQVTDHVQVIVQLLGQAFALPQAGDALLPLAGAAGLVTLQVVEADPGMAVQVGVRRVLAPQ

SEQ ID NO: 32557 - protein, 478 aa, Pseudomonas aeruginosa
LGLSVPDHGCRQPDRELRQRGAEAALPATDDRGPLLRHHGPHRTARRLLPLRHPHPRRTGRRRQLSDQGQQDLHLRRRPPALREHRAYGPGQAAGCTAGGERHLAVHRAEVPGQRRRQPRAAQRRDPRRPVPQDGLSRHHLHRAELRRQRRLRRLPGGQAAPRPGLHVPDDERGAHRRRHGRGDAWLCRLPLITESTPRERPQGRLPDGKDLSAPQVAIIRHADVRRMLLTQKAYVEGAFDLGLYAARLFDDSQTLEDDEQRRQAHDLLDLLTPIVKSWPSEFCLKANELAIQILGGHGYTREYPVEQYYRDNRLNPIHEGTHGIQSLDLLGRKVGQNNGAGLRQLTRLIQDACRRAEAHPSLVALRQPLERLVARLSEVTLALLGDLMQGQVNQGLANSALYLKVFGHAVIGWRWLEQAIRAEEGLARGDCADADFYRGKLQAARYFLTWEVPGCHHELALLEARDDVCSSMQEEWF

SEQ ID NO: 32558 - protein, 591 aa, Pseudomonas aeruginosa
FLPDRGGAGRHEHPRQLAVLPPGHPDPGDLPRRRHDRRQRRGRRHRLRQLSDGLPGGQPGARRDPPRRRPAHPRLQLPRGALAGIVAGHPGRAGDHRPDRHRGSLAVRPALDGRPADRRHRRLHRCRRGVLPARRQRSQRAGHRDPGNRIGQQRPNGGVPHRDPDRDARQRPDRPQLGLRPAPGAAVRSRRPARSWRRLVAAATDQPHAPGRRPLPVAGDQRRPAGVRPGQRRRRQRHPRHLPVRPAPRQPPDPQPPRHPAHARRHGLAGADRHVPGPRPAGHPPRPVADRPAGTGPGAVDDPGGTTAVGTDRTDPVPRLPRPRESLHRLGRPARRGADHPRGVPADGRPAERPAVLQRGLLHRPGLAAGAGHQPALGGQAAAGGGAAGSGTDIPRRPGDPPDQRVGAVRLPPEQGKVVHRRRPARAEDARRDPDRRAVPRHRTAPPVGQHHPRGRRHSLRDRPRTRPAGPRQAVQPGARPGPRRALLRRLRAGRRCPAVGGGLALRPEARRHRRRASAGPLHRPRDRRRSGDRRPGGVERPDLDRGRPGRQPYPQGRREVSGRPPRARTFPLISCRIPVPRRLAAPRSHH

SEQ ID NO: 32559 - protein, 97 aa, Pseudomonas aeruginosa
RRPKNVRSANATAARARPAWKCCSTTAPPSRPSGRKPWARPTACRSPPRPVRNEPRPASAACRHGSWKSARCSRPARKAARRSTPTVAASCSPSRPH

SEQ ID NO: 32560 - protein, 289 aa, Pseudomonas aeruginosa
RAAARQWGSQRSHPTESAMIRHLLVAHDLTPEADVALARAAQLARQHDARVSLLHVYDPGLSASAVKTVSAMLQLKRKEAGLDEDSAIHLFRGQPIDGILQQTRALEPDLLLMGAHHQKTFERFGNTTLDQVVRRSRVPVLLAVREADEPYRQALSALDFSQCACTALRQAYRLLPVEADLHALHVFESPDDGVLGLPRQNAAHLATQAGLIEQLLSDEQERLPGVGPQLSHEVVPGVLPYSLDAALKQRQPELLALGRHSRNALMQALLGNLAQRYLRQPSCDVLVTS

SEQ ID NO: 32561 - protein, 325 aa, Pseudomonas aeruginosa
SGSAPAQAGRLAGHQVDEGQRQRRALVLPTDQPYRSRRLGIAQGAVDHAVDPGAAERRRQDRHPQSGRDQADDGHRLAGLLGDARAEAGLSGQGDDLVVEPGAVAAREEHEGLLGQGGDGQAILAAGRQRMVGPQHRHQRFAEQLHPMHRIRQRQRADHAHLQAFLEQRLEYLAAAHFLQVEVYVRIGLAEGMDAAGYGRGEGCRGSETDLQLAQFPQVGPTRQQHRLVYLGQHLAGLVEEQPAGVGEFDAAVGALEQARTDFLLQRLDLLAQRRLGDPQALGGAAEVQLLGDGDEIAQVPEFHAAPPIRSFYISIVSINILEII

SEQ ID NO: 32562 - protein, 799 aa, Pseudomonas aeruginosa
TYLYPLPHNLQQRPLVPEIQVARPRCACSPPTPEVPREQSASPATGRRRTRVNRGGPRSSQRGAGSRHRSRTLYRKRHPAVHAHLPSAVLRRFRHLCPALLHPADDAGAVQGVFHQRRGKQPGIVRRHRHARPWPAGHRPDLRRDRSQAGDGRLAAGRRAVHPRQRGDAHLAWRAADARAGRAVLERPGRGGDDLSQRRDPSAAHRLVDGPVHRRQRHRRDERTPDQRRPGRFHLLACRTGGPRRPGPGRRAGVLARAARIETLPAGTAEAGDPAQRLPPALPRRRTALAVPDRLPADGQLRHPVQLHRLPPAGRALPHEPGGGRRALGGLPLGHLQLGLGRFAGRQAGATQGALGGHPADARRPAADPVRADPADARRPAAIHLRLLRRALGGEQLDRAPRPARQGPGLVALPVQLLRRLEPGRHPRRGVLALLRLERHRAVHRLAAGGRGIGLAAPGAPAGPAWQHPGAGRPLSSSAGLPAPSLRPEAYSGQFLRSRPQPRGQPQVARIPRNPRRRRITAGFQPAIRADIGAAIPALFGQRGKCRQRPHLRRLRERSVGHLHRPASQARTGHRRRRVLQVGRRVARMRRQALQKHAPLAGAALQLQAEQQIGLLAVAIGEIAVVAALGVEVVERQPAELVETAGHAHHPGPWSGQQRLQQQSRKGEVAEVIGAHLHLETVAGTPQGQEHHSGVVEQEIEAFVALTETGGAGADRGEVGQVEIGQLQACLGILVEDRPPRPLRLFAIAAGHHHGRPFAGQRARRLPTQAAVGAGDQRQAPGQLWNVASCPGMHRSFSA

SEQ ID NO: 32563 - protein, 388 aa, Pseudomonas aeruginosa
LRCRAVSRHQPMQRQTRSRQTADHFGPGHASMSRRTDSDAPTITAAYPRLLLGLLEERGLDGRALLREIGLSTLRLEEPEARVTSQQYQAIAAAALALSGDPGLGAQLALRTPPTAHGSLGYAMMASATLGDALCLALRYMPLLQGNVEISLLREDEQVILRMLPGPALPPALHRYFSEALLIGLYRSGAWLLGEPALVGRLDFDYPEPAVPVPLPQCRYDQAHVQLVFPAILLARSLPMADPAALRRAREHCERELALLDAGRRDICARVRLELERQEQRFPNLEEVAARLHLSSRSLKRHLHDAGTSFRQLLGQARQRQALRLLRRPEVSLQRIALYLGYSDPTNFTRAFKRWTGEPPSDTRARLLGGQPVSRTNAKRSTNPSRFP

SEQ ID NO: 32564 - protein, 357 aa, Pseudomonas aeruginosa
KGLYETSDQARLPARHGTVLPLRQRSPGGRRSGRNLGPAGQRPARRGLPRRRQPAGGGRRQHPQLQLRQRGLVGLRRHRYRRPARRGNPGQGRSRPGDRFPRQHHPAQVPGRQRLLGDHARHRRRQRRRRRSHPQHRQRRAHRIRSHPYATRRHLQLQRHLGPVRRRRRGRRAGQGTGAEHGQRRQGHRPAHRWRQGLHLQRLPRARTDRRPRRPARRGDHRPHQHRHLRDQQRQFPQGIQHRRQRLGTLWRHRGHRRQAGQRADRGDAGQGAGHPPRQRRQQRLPHRRRQLQHRFGGRHGWPAGRGNPRARRQRQAVRDQRPHRQGKQLSRAGCVGRVRHRRDPASQRAGGPSARA

SEQ ID NO: 32565 - protein, 147 aa, Pseudomonas aeruginosa
GSWSPIAPACPAERAWPEGCRRASPWTCGSPCSSRPRPCRWRGSRGCRRSRSAVRGRSARGGWCARHPSHSPGPVPDREPAAPRCRPATRPPCGSAGLRRSRSTGPGPWHREWSGYRRRGSRRPAAGNGPAAAGSLRRPAPGSCTGS

SEQ ID NO: 32566 - protein, 610 aa, Pseudomonas aeruginosa
RHPIKGCWLHAGACGRGLSTGRRAKRAAIVAKHKTKGTAGAVPFVYRGDLSQRRWRRGSDAKVVEDAFGRGTSFEDRRHHQVGTTDHVATGEDLRVAGLVLELRLRRSHHAALAVGGDLEALEPRRRTRPEAEGDQHGFRRDDLLGTGDRFGAAAAAGVRLAETGLDHLHAFHPVLADDGDGLAVEEELHALFLGVLHFLARARHVFFVTAIGTGHRLGALADRSAVAVHRGVAAAQDHHALALHVDEVLGRLLEAEVAVHVGDQEVQGVVYARQVLAGETALHVGVGAHPHEHGIVLIEQLLHGHVLADLGVQAKLDAHAGEHLAATAEDVLLQLELGNAEGQQAADLRVAVEHHRGHAVAHQHVGAAEAGRAGADHRDAPAGRLDLGQVRTPAHGEGRIGDVLLHRADGHRAKTVVEGAGALAEAILRADPAADFRQGVGLVRQFGGGQDVAFGNQLQPVRDEVVHRAFPLAVRVAAAQAAVGLVGGLLRLEQVVDLHELALALAQQLLLRVLAPDFDELEVVVQAVGIQTFRHIETSSQLRALIAGWHGCWSAANRGWPPSVSPARTDAGSHPGFPGCSRPTRLPFRSRTRPGPCAGGCDRPPSPRR

SEQ ID NO: 32567 - protein, 128 aa, Pseudomonas aeruginosa
NGTPPVPWPCPGCRAGGRSRRIPARRWIGRSCRCPARTRRRSGLRWRPSTARPSSRPAGPGRTAGFSPPRRTAACRPGSAHCPATERDPDSAAWRSRRGGSPAGRCGRSARPGCARRGAPATRGFPWR

SEQ ID NO: 32568 - protein, 957 aa, Pseudomonas aeruginosa
PCRPATGRPRRGMGALGHLDLQDLGVDQVFRGHAEAAGSHLLDLRTLQRAVARRVLAALAGVGATAQGVHRLGQRLVGLRRQRAEGNPGGIEALEDGFQRLHLVERQRLRGGLHLQQVADHRHWALVHQRGVFLELLVVALLHGSLQGIHHIRVVGVVFAAIDELQQAALLDRLAVAPGLGGQELLLVLDIDEARALDAAGDSGEAQVGDLVGQAHRLEQLRATVGRDGGDAHLRENLHQALGDPLAVVLEHLVEVAQHFTGADQVGQHLVGEERIDRRGAEADQHREMVRIAGGGGLHQDVGVAAQPGLHQAVMHRTDGQGSMHRQFAGSDMAVAEDQQHLAAAHGLLGLVGDVAHRGLQAHRLVVVEVDEVAVEARAVQGHDGPPLRRRDHRSGEDRLVGMVRGFLEDVLLDAQAGFQGHHDGFAQRVDRRVGDLGELLAEVIVRRADAPGEDRHRRIVAHGAHRFLALLAERTQHLVTLLEGDLEHLHELLELVGVVAGHAMVVVQGRLDAQGILPQPLLVGMARLQAVVDVVAVQDLAGLGVHREDLPRADAPLGDDVLGLVVPDADFRSQGDVAVLRGDPARRAQAIAVEQADGIATVGQHDAGGAIPGLHVQRVVLVERAQVGVHGFDVLPGRRDDHAQAAEQVHAAGDHQFEHVVHARRVGADAVHQRAELFQVGDQFVGELGPPRLGPVAVAGDGVDLAVVGEEAERLRQRPFRQGVGGEALVEYADRGLQALVAKVRIEGGQVGRHHQALVDDGFVRKAADVVVAVGGVGHRRAAPCAEQLDGEVLVAQAGAADEHLFDLRQTLQRQAAENAGIDRHLAPADQLQSGGDDLAIHVLACRLGFHRVLVEEHHAHRVLLGQVDRKGFPGDGTQEQVGLLDQQPAAVPGLAIGIDPTAVGHAGQCFDCGLQKLMARLALHMGDQAKSAVILERFRMVQTCFHKELSPAKLF

SEQ ID NO: 32569 - protein, 158 aa, Pseudomonas aeruginosa
MFSTLAPMLTSSFMQEMAAAPAPRQTIFASSSFLPASSSALSMPAAVTMAVPCWSSWNTGMSHCSISARSISKHSGALMSSRLIPPKVMEIRLTVSMKACGLSASTSMSNTSMPAKRLNSTPLPSITGLEASGPRLPRPRIAVPSEITATRLPLPVYW

SEQ ID NO: 32570 - protein, 565 aa, Pseudomonas aeruginosa
PLAASRQLLQRLPRLDLHQVQASRLRQGPLLVAQRTEAADHAEEAVVLGLQGTDLDHADEQVGAVALVDHSNPSRRVAWHHRRVAVQSCLLQRLFLGQPLPGVLAQELRGRQAGIMGHQLHADERLLVRRIAKQGTGLVEDLPARRIAQGEVQLGMVEVLPATHPGRCRVAERHAFQMAKKDLAPHFLLSVGQLPGRADHFLQTPVVVRMGIEQPVVAAGLYRLAIARSLFASEVLLVLQHPHHLDHRRRIVAGAGQVLSAETIGFQFHVTPVAADEGRAEHVGQVAGGTDPGADRHRLAKDVPGAGLALLAHAVARRDVADLMTEHRGQFGLGAKVGDQSAMDIDVAARQGEGVDVRRIDDGEMILQIAAVAAAGDPLAYPLHVGLELFIVVAGELLEDFLVVASAHAEFLLLAHHHEIALAGGRVHRAAAQRADSQQQQQEPGGLHGNHSSIAGSVTDICQRALPAGTAPRRERSTTQPRTSSERPAICITRFASNALSTFGSIRRTSGPSISSQIPPRLSSTSSTRPRTTAKPLCASRSSESTGERFHTPRLAERAARSAAC

SEQ ID NO: 32571 - protein, 250 aa, Pseudomonas aeruginosa
RLWNACNRTRPNRSPGTPMAKKKPAPKRGASRYQAPAAKNGVPGWVWLVAGLAIGGFIMFLMKLEPGRKDVQRERPDAQRPAAAVQGKQPQQNGQAQQPAQTQTPAQAKPKYEFYTLLPESEVVVPPEAVPEKAPPPPTPAELAKADEARAKAALAGQVPPPLPKAVVAASTQFFLQAGSFRKQSDADRVRAQIILLGQSVNVEAGNVRDETWYRVMVGPFNSRDQLSQAQKTLSSNGFSNLLLQQRKAR

SEQ ID NO: 32572 - protein, 179 aa, Pseudomonas aeruginosa
SMPATSTATSASWPRTRTCPATSFDHRRRHGQHRGGGPRGPEPGYPCTPPFRESDAMRIPSAIQLHKASKTLTLRYGEDSYDLPAEFLRVHSPSAEVQGHGNPVLQYGKLNVGLVGVEPAGQYALKLSFDDGHDSGLFTWDYLYELATRKDQLWADYLAELVSAGKSRDPDESVVKLML

SEQ ID NO: 32573 - protein, 482 aa, Pseudomonas aeruginosa
RPTLFRSGLEPESTVQALHADLPGLAQGAAQLDQPQRPVAAGHQSWPVRHQPADRGDVADQQPEQPGGGQALLRDRRQEPAGRPRPPGQGPGEQRRDAEPGGHGRLRGGQEPGHHRGRRGVPQRRAGTDPVPADHRVGARTPAAGGAAADQQVLRLRPVAGQEPGALLPAQRRADLHRQLAQPDQVAARMGPDHLYRGAQGGHRGSPVDHRQQGPQPPRRLLRRDHHRDPGRPLRGQRREEGQRLHPTGQRARLRTEYPGRAVRRREDPGGRQASLLPVRRAGGQGHGQGVRLDAPQRPDLELLGQQLPARQPAAGVRHPLLEQRHHAPARRAARRVRRTVQEQPAEPPRRPGGLRHAHRPEAGDLRLLLCRRSERPHHPLGVVLQVGQAAGWQVRVHPLQQRSHPEHPQPTGQPQGTLHDQSGTARRAQGLAGTGRQARRLVVVALAAMAGRTLRQDPQGARQPGQQDLSGRRSRARNLRA

SEQ ID NO: 32574 - protein, 338 aa, Pseudomonas aeruginosa
TMKSDQPEEQPQERSAASADETPPAPPARPRAARKPARPRIAEPAAAPPRTPSMPQPFVFRTIDLDGQTIRTAVRPGKEGSTPLLIFNGIGANLELVFPFVQALDPELEVIAFDVPGVGGSSTPSVPYRFPGLAKLAARMLDYLDYGQVNAIGVSWGGALAQQFAHDYPERCKKLILAATSAGAVMVPGKPKVLMRMASPRRYIQPSYGVHIAPDIYGGAFRRDPKLAMAHASKVRSSGKLGYYWQLFAGLGWTSIHWLHRIRQPTLVLAGDDDPIIPLINMRVLAWRIPNAELHVIDDGHLFLVTRAESVAPIIMKFLAEERRRAVMHPRPFLPKTG

SEQ ID NO: 32575 - protein, 582 aa, Pseudomonas aeruginosa
VFRARGRSPVASRLWSYDGVWSMREKQESGSVPVPAEFMSAQSAIVGLRGKDLLTTVRSLAVHGLRQPLHSARHLVAFGGQLGKVLLGDTLHQPNPQDARFQDPSWRLNPFYRRTLQAYLAWQKQLLAWIDESNLDCDDRARARFLVALLSDAVAPSNSLINPLAVKELFNTGGISLLNGVRHLLEDLVHNGGMPSQVNKTAFEIGRNLATTQGAVVFRNEVLELIQYKPLGERQYAKPLLIVPPQINKYYIFDLSPEKSFVQYALKNNLQVFVISWRNPDAQHREWGLSTYVEALDQAIEVSREITGSRSVNLAGACAGGLTVAALLGHLQVRRQLRKVSSVTYLVSLLDSQMESPAMLFADEQTLESSKRRSYQHGVLDGRDMAKVFAWMRPNDLIWNYWVNNYLLGRQPPAFDILYWNNDNTRLPAAFHGELLDLFKHNPLTRPGALEVSGTAVDLGKVAIDSFHVAGITDHITPWDAVYRSALLLGGQRRFILSNSGHIQSILNPPGNPKACYFENDKLSSDPRAWYYDAKREEGSWWPVWLGWLQERSGELGNPDFNLGSAAHPPLEAAPGTYVHIR

SEQ ID NO: 32576 - protein, 509 aa, Pseudomonas aeruginosa
KIRPGRLEPGTSIPRRSPDEDTRPNPRMLAVAVQRTGRAQRLDTGDRQRTGHQPGQSLLPLPWQGTAGDGAVRAVPGRVGAAARSARGGAPGRGGLLAVPAPDRRAPRPLPLPVPGPVQPDRAPATAGSRHPYLARRAEADPGHPAGPPQGRPAVAQRRAGTRATGRTDHPDPAVLPGLSAGTGQQGRGAHGGLPDHDAGRPASAQRGPTLGGKPGAALPGTGMKNARRVPGVCLAARTQPWLLGVAGAFAAGALAAGVAAGAAGALEDAAGAAGFAAAGLAAGFFAAGFFAAGLAAGFAAGLAAVAAAGLAAAGFAAGFAAALAAGLVAGFAAAFAVGLAAGLAAGLAAAVFAAGFFAAGFAAGLAAALAAGLAAGLAAAVFAAGLAAGFAAGLAAAFAAGLTLTPVSFSICLVSVSTLLCSSFTSLRLGTPRREMALFRRLSKASSSSLHLPSARSRTSSTLLFAERAEAFAAPTCASTSDFASFSAFSPSFTKVSNSLLPSLLTFE

SEQ ID NO: 32577 - protein, 209 aa, Pseudomonas aeruginosa
CPVASIACGSASPSSCPACAAGTACSTSPAGTGDLTRQFSRLVGPTGEVVLADINASMLKVGRDKLLDKGVSGNVSFVQADAEKLPFPDNHFDCVTIAFGLRNVTHKDEAIRSMLRVLKPGGRLLVLEFSKPSSNLLSKAYDAYSFSLLPLMGKLVTNDSESYRYLAESIRMHPDQETLKAMMVEAGFDRVTYHNMTGGIVALHRGIKP

SEQ ID NO: 32578 - protein, 594 aa, Pseudomonas aeruginosa
SWPSIVSTRASDASAKRPSPTHEAPRCPPPPAHPARRHPLPPGRPDPRTADAALVAAPARCHPALALAAAAQAGTDPRRAPAPGTAGPRTDLHQVRPDSLHPPRPAARRHRQRTGLAAGQGAALPAGAGGQAHRGTAGREDRTGLRPLRTRTAGLRLGGPGPRRAPEERRGSGGEGDPAEPGTGDPLRHRLAVHPRPPRRAGLQRGAAPAPGGSGQRLREDHRRRTRPAPRGGQRLAAATQLRRLAAALRATGLLGLVPAQGAGDGAHLRHPGDRPGNPARPAHRLQGTGRARRGDLLHPGVPRQLFPCRHAPRQHLRQHPRALEPAIHRGGLRHRRQPDRRGPGLPGAQPDRLLQARLPQGRPTAYRLRLGTGGNQGQRLRGGDPHRLRTDLREAAEGHLLRPGPAAPVPDRASFQHGDPAATGAAAEDPAEHRRPRPPALPGTRPVGHRPAVPGALDARTGQPEAVAAQFPATGRAGAAPVANGPRHPRTPVTTARPQCAAAGVERFPPRLARAPGGRGAAGRRRRGRPGSAAGSLAGVGDAGRRGVPDPAPLAPRTATRPAPIASRAPGWHTTPISAGNARNVPATNVERP

SEQ ID NO: 32579 - protein, 146 aa, Pseudomonas aeruginosa
RTRTLSTNTQDTTMSDTLTRLAAVLEERKNAAPDSSYVASLYHKGLNKILEKVGEESVETIIAAKDAAASGDCQDLIYETADLWFHSLVMLSALGQHPQAVLDELERRFGLSRPRRESRPPTIGLNLHIARNTTWAFLTGNTGSSS

SEQ ID NO: 32580 - protein, 143 aa, Pseudomonas aeruginosa
PSMFGISFSELLLVGLVALLVLGPERLPGAARTAGLWIGRLKRSFNTIKQEVEREIGADEIRRQLHNEHILSMEREAQKLLAPLTGQNPPQETPPPAAESPAPSVPTPPPTSTPAVPPADAAAPPAVAASTPPSPPSETPRNP

SEQ ID NO: 32581 - protein, 141 aa, Pseudomonas aeruginosa
WTPASRSRPATRRRCNVAVRWPTCTNSCSWCVTRCAATSSNAATRPSRPRSPRSTPSARPPRRCVASCPARPMRRWNRPWVASRAIVAGSSSSVPASSARARRSKRCKAAPRIWPGPAGPSPKPVANCARAPPAATAPASG

SEQ ID NO: 32582 - protein, 252 aa, Pseudomonas aeruginosa
TCRSPLPRSNRARWPRRSTAASSAYATSPSSRPPPASRPPPPAASWRAWARSCRHRWDASACNIPRGSSLHRQPLPSIESGQEGHLCVGSGFRLLGDDAMRPMTIDIDELAFALDTPGIDHYLDLYSGKVLLISAEAPDPELDALLENEPERLLLIDPLSTTQSLGLMQDFLREVEEPHAYATLANALQSRKPFKAFKHSLMEYPELLQDWYRYQNERLREWALDWLEDNDIQPAARQSPTSLLPPPGKPFA

SEQ ID NO: 32583 - protein, 66 aa, Pseudomonas aeruginosa
AHASGSRRCTRRWRAARAACRTPPGSGTAFRRGRAGPASPGWRSPIPGSTGSANRRSATATTGSAG

SEQ ID NO: 32584 - protein, 152 aa, Pseudomonas aeruginosa
SGPPPWGWGAAWRCGPPRSTRPWRRASGRSGRYRSGACGRPPAGRRALPAGSARHSLPNSRGTGGWRLPGRTSGCPADGKGRCRAGSAHGPARDGSARRPATGSSPRNRRTAPTSRYPGARAGAPCPPPAPRCCSSPGWRGAWNGRNRAGRR

SEQ ID NO: 32585 - protein, 530 aa, Pseudomonas aeruginosa
RAWAATSSISAKSAGSPATNCLACRRSIRPNWPTTSGRAWTRRRRRSATSACSARRSLHRIAGGVLEDRLQLRGHGKLQVQPLGRDRLLEPALVDALYLARAIQPGQGLVDQGKELRVVLAHHAAVDLPRLRLADHHPVVRLARLGAFAVEQRIVHVEGHRATRLQHLEGFAVVLGADHVHPQLVFGVVVLQVALVGGAGGGHHVLALEVVEVGDAAVLAGQQLALDVDEAVGERHLFLPLGGDPGGAALQVDGAILHQRDTGLRSDQVVLHLEFRLAEGAFEPLHHLVGQFHRIAHGLAAVIAKVGERHRGIAITQGYRAVVGNLLQGAAEFLGLRGADGERQGECESAGYKDFHRRFCLFFLMAMESKSAPGRHHGDLHQHRRTRQLRLDGGPAGRLAGRQPLGPDLVQGGEIAGDVLQVDGRAEDTLLARPGLGQQRVDLRQHLAGLAMDILGLARHLAGKKYQGVEADRGGQAVIGGDTGRFHGSAPGRGEFSQPARRAEAGQRYRCSAGGGRSARPAGARCRRPG

SEQ ID NO: 32586 - protein, 284 aa, Pseudomonas aeruginosa
VRHPPLDEAVNVVVGRLVEDFPWRADLDQLAVLEDRDAVADAYRLVEVVGDEDDGLVQGFLQFQQLVLHVRADQRVEGAEGLVHENDLGVGGQRAGQADTLAHAAGKLVRIGLLVALQAHRGDPVQGPLVALRPAFAANLQAVGDIVEHALVRQQAETLEHHADLAPAELPEGFHVVAQDVLAIHQDLAAGGVDQAVEMAHQGRLAGTRQAHDHEDLASTDGQRQVVDADHAAGLRQHFALAASLADKGQRGIGARAEDLEHVLHFDLVHLRTAHLLVSCRERP

SEQ ID NO: 32587 - protein, 74 aa, Pseudomonas aeruginosa
NSRMRSGTALIARGITRCGSCASPAVMPKISMPPKANTTSDREATSPGPAVGQEPAVLPKVVHAGGGSRRRRPS

SEQ ID NO: 32588 - protein, 667 aa, Pseudomonas aeruginosa
TGCRGGRGARSPGCSRSSAVRSVACCRCPGSCCCTPLRLARRHSCCGLVGTVGGRPHAPPAWRRFSRSALGGDHRQVQALLLRAIDGDLVAGVGVPHHPGTRVVGQHAGDAFGGLVATVADDHHPGVLGEAHAYAAAVVQRDPGGAAGGIQQGIQQRPVGHRVGAVLHGLGLAVGAGHRAGVEVVAADDDRRGQLAAAHHLVEGQAELGAQPQANPADARRQALEANALAGHVQPTVQVGIVGDQLLDLGVGLVDVLRVARQRGPAERTDAATEQRADVGRDEAGEIEGIGHPLFLGHLADVVAIVEGRHALLLERQHGPHVYRHGLLGGLDHGGRVGLRAVAVLFPAPAGRQVAVEWIVGAGLVGDHVRAYAAANQFRKDLGGIAQQGDGDGLAFGGVALDPRQGVVQVLGLLVDVATAQAEVDAALLALDVQRTGAGQGRRQRLGAAHAAKAGGKHPAALEIAVVMLAASLDEGFVGALDDALAADVDPRTGGHLAVHRQALGVQFVEVFPGRPVRHQVGVGDQHPRRVGVGLEHADRLAGLYQQGLVVVQLLEGLDDPVVALPVARGTADAAVNHQFPGVLRDLRVEVVHQHAQRRFGQPALGGQRSAARGADFNIAEFARGGHGRLLGVAFNGRRPARVRLNSGTKQRSGWVYRTHLCLYIQV

SEQ ID NO: 32589 - protein, 431 aa, Pseudomonas aeruginosa
IIRGNWSSNRISASQPSASAVHSCKPPSSAWFTRSPKRPPASASWQTFLPNHRPLRWATTSAASLEVPNHQSSKVSQGALIGLLRVVAGDALDFLLRAEEHRDTLVQVLRLDVEDALGAVGGGAAGLLDDERHRVGFVHQAQLAGLLRLAGVARVHEDAATGQDAVDVGDHRGDPAHVVVLAQRAFLAGQQFFHVAFHRRFPVALVGHVDGELGGAFRHADVVVGEDEAAQLAIQGEALDAIAEGQHQHGLRAVDGVAGGDLGGARLEEGFLAQGIVLVQVLVGAAQHREDGADRDVDVDVAGAVQRVEDQQVGAFRIAPRNLVGVVHLLGGHAGQVAGPFVGFQQDLVGHHVQLLLHLALHVLGAHAAEHAAQRALGHRMADFLAGTRHDLDEEAQVGRGVVAAGLLDQIAAQGNAGHGWLRREEKTRAV

SEQ ID NO: 32590 - protein, 297 aa, Pseudomonas aeruginosa
SFSYSVICFYCRAAASSACAPGPVVKPPQPNSIARNRLMACSARNAAGSLPLLPAERPPAEVPPTGRSSSSRYPVPAPRPPWPPPAVRPGWRYPGWRACSRYSRESVRRAAAPPTARQACRTPAGTAGCHAPGTPVRWPAGRHSGTGPPGPGRYLVGPPADAARAPPSPAVPARSAVRCGRRSAAGREPRVPGCSRRPPGAAKRSPYDHGRTVPPGRWCGSAPAAGTPAPAATATPAATASGTRRPPPGARPAARTRSSAPARCSACCLAGGRLGGLPRLPQPARPDAGSGPGGREA

SEQ ID NO: 32591 - protein, 162 aa, Pseudomonas aeruginosa
RSSGRSVRPPRPANARGRRWLPRRSAGSPPPGCSSPAAGAPGETSPRSRRSASRAKSRQPARRFPAAPRLWCRWCCAAPAGSVASRRRRTCLATGTAAPRPHAACWPGARCRPPGCRARPRLRHRRPAGRAGRHGQPTTARSSGCSGDTRDLRPAATAPPGG

SEQ ID NO: 32592 - protein, 237 aa, Pseudomonas aeruginosa
EVADDQQQDADPDEGDDSLQAATVAQLDEEQLDHHDADQRRADHPQVAPAETGTGDGQAQRTERPDQRQPRLHQHRRGQRLGLERYAGQVVRGAAHRQGQQGEQRGAGQRLAPQARAGIAIDERGQAGVAPAVEGEQHDQQPQFQRVGQRQVRQRLGSAVAEQVGAPEPAEQQQRHRRSGEQPILPREVAQRPGQAPPASHQQQVGARDQRPAQPTPGVVLFGEQGEQVAQLQRQHP

SEQ ID NO: 32593 - protein, 293 aa, Pseudomonas aeruginosa
QRMLAQAIRHEADGFAQRGQRPPAGSPEQQQVRQLGQAEGTDTQRPLALAGAAQPPGADQRRQGQHCRRPEPGMGQGPQAFAAQRAEQRRPGEEERQAAHYLQGEAEVEAQALAQHQAQPDDQQPATGPYRAGAAPRQDEQHCQVDERQTGQQHQAQAHEQPTVVLHQRVARRQQHAADQRQANQRGGHQATPARVEYPTLAIAALQMQEEQRTAQQLHGEGAEQEGTRAQAQAGEQARQAGPRPRRWRCRRRPGRAVRPGRGRPGRRPPATAGRPAPSRPALSPARDAAARS

SEQ ID NO: 32594 - protein, 125 aa, Pseudomonas aeruginosa
TALHGCRCRWRSGSARRSRRAPPPPPGPWRSAARRGSPSRSSPPPAGPAPRRERSADAGAWRRRWSGTAPRYRCLAGSGRRRRAARAATSRRRAAPSLPAPPRRSGTPPAPPPVPRHSAGGRPGR

SEQ ID NO: 32595 - protein, 152 aa, Pseudomonas aeruginosa
SSTSSRLEVKGMRQLDIGEVARRSGVPASTLRYYEEKGLIASSGRHGLRRLFDAGVLERLALIGLGRAAGLSLDEIAGMGAADGALRIDRAALAAKADELDRTIRRLAAMRDGLRHAAACPAREHMDCPTFRRLLRAAAAGAIKPRRKAPGA

SEQ ID NO: 32596 - protein, 185 aa, Pseudomonas aeruginosa
GSCFSPSFSMITTSGRPTASSKPSRRMVSISTDRCSSPRPETLNFSGLSPGSTRSATLCSSSFSRRSLMLRLVTNLPSRPANGESLTWKVMLTVGWSTVSGGSASTFCGSHRVSEMNSSSMPLTQTMSPASASATSTRCRPWWPMIFRMRPLRLLPSSLMATTGVLDLTLPRVMRPIPITPRKLL

SEQ ID NO: 32597 - protein, 85 aa, Pseudomonas aeruginosa
TIGKSSCSSVAPRLSNRSKIWSMTQSGRAPGRSILFTTTIGRRPALKAFWVTKRVCGMGPSWASTTSSTESTIDITRSTSPPKSA

SEQ ID NO: 32598 - protein, 139 aa, Pseudomonas aeruginosa
PFHLIAVFFARMVMPRSFSWSLESITRSLSASLRSRVPDSFSSLSTRVVLPWSTWAMMAMLRRFSITSLVSFNARSAASRRWWGRTGRRPTRQASSIKGRAAGGRCPGPAGTPKGGHRPRRRTCREDGGGCCRRTSPAA

SEQ ID NO: 32599 - protein, 137 aa, Pseudomonas aeruginosa
GPSMRHSLWLLLAAILSLPAQAGTECRDIHDRDLRRMCNALERGDSGDCGDIDSRDLRRYCGALLAPGQRYDCDDIRDGDTRRQCRAIVRGDRKRCDDIDSRDMRRQCRAVVSRAPWQCDGIDDRDMRRICRVILSR

SEQ ID NO: 32600 - protein, 111 aa, Pseudomonas aeruginosa
  UNSURE (105): Identity of amino acid at the above locations are unknown.
SSIDSESSMMMNRPVIRSATSDCAPKPMARPITPAPASNGVTFMPMLARATIRARNATSPNGRRCSPPWMPAWSRCCRSPRRWNTRSCRRAGWSPGCRWRTAAAXRRWPVR

SEQ ID NO: 32601 - protein, 184 aa, Pseudomonas aeruginosa
RSRPPPPPRATRRPLAPGSPPRAAGRPARRPWPDRGPRCRCGDSRARRRGPAPCAQPGFRSRPPAGAAHRPAPGSRRPAPSCRRYAGRSAPKPPATPAGDRLRRRTERTPRPPPAGHAPHCQGTPSPVSRRSPHRPATPASVAARPAPARHGSCAAAHCKAWPGRCATPRSVVDKTGARRPRRC

SEQ ID NO: 32602 - protein, 467 aa, Pseudomonas aeruginosa
GSCRSWRHPLARGEAHPADADQPARPPDHHHHHEYPEQQHADVGEAAQQLRRHGEDEGGVHHPDRRAHAAEHDDGEDQRRLEEVERGRVDEALVAGEEHPGQSRGGGAEHERREFHQHMVEAHRATGDLVLAQRLPGAPDRHPGQPVLDVEHQQHDQEQHHVDEQELHVGVVGDAEELVDRHPAILGPAAELQAEEGRRRRRHAVRPAGEGQPVVQYQADDLAEAQGDDRQVVAMHAQHREAEDRPGHRGGQRGQRQDGPEAQAEVLVAQRQAIGANGVEGHVAEVEQPGEADHDVQAQAQQHVDQAEDDHRQQVLAGEEREDHRGHQDQRHDPAQAGLVARRQDVDAAASPLEALQHGAPAAGLQVEDEQEAPGHHDRDDPADPLVMQVEAVAVEDHADDGAEHHQGDQPGEHGIEDALLEIDGSLVAHRRPLTPWRSAGGRAGPGDGRSGSVPATRRRTRPCSRC

SEQ ID NO: 32603 - protein, 239 aa, Pseudomonas aeruginosa
RRQAQRADGETLRLHAHHLPAHRRRSPGPHRRRGLVHQPVDHAPAFRSARGDPPRAGLLESHAPRRCARARRSVRYGARLQYDAGKPAGAASASRRDSQEAHHHLGRDECHQQPGQPCRHVPGRPDRHGRHGGTPDEHGGPGRGAERPGRRSQRGIGEQRGAHRNRTRACEPRRHPGPVGHGRRGGSRHRHATQQDRGNQHRSGSHPEHRPANQPARPQCRDRSRTGGRGRTRVRGGRR

SEQ ID NO: 32604 - protein, 469 aa, Pseudomonas aeruginosa
SSAPTWNDWIAPSPAPTRRSEHGRKRLCRAHRAEPARYRFLQADHDAGGAAQLPQRRSGVGIPLPQRRGPASVPGGDPLPDRAPRRSRGNRRPARLPRTHPVHEAGLHPLPQPVPLQPALRAHRHRGWPTGNPPARPMAARDPLRGAAAGHRQRGAQPLSLPRGGPGTGRRAALSQARLALRPGQQRGTRGIPGRRLRHPPALLLPHPGGSGAYPQARLPRALRRHQQRAPGPRVRPQADRHHGPRMADGPPATRPAAGRQPASGAGLLGPRVPRTARHSPDRLHYHGCLPRRLRPVLRQALRRPAPRFGRPAGLGGESHRPLPPPGYRPAEQDPGVLRRAGHAQGVAAVPRATWQDQRQLRHRHQPDLRHPGGRADEHRPEDDGLQRPSGGEDIRRPGQDPMPRRELRRLPPPRLQRAGLILSHLTGARTCNRSNATSPKPCRSSRRSSRRPTCRRRSPGASPSSSSA

SEQ ID NO: 32605 - protein, 317 aa, Pseudomonas aeruginosa
KEAVSLRRPAMRTRLPALLLGVLLAGQACGHTSPLLAPVRQFHAFGDSYSDNGESQRLTREMLAKGIAGAQALPGEVYWQGRWSNGPTAVEVLARQLGAQLADHAVGGAKSGADNYYGWMSAYRHTGLAGQVDAYLATLDGKPVDGQALHFIFVSANDFFEHEDFAGEQPLEQLAGSSVANIRAAVQRLGEAGARRFLVVSSTDLSVVPAVVAGNRVERAQRYLQAVNASLPIQLAALRKTRGLELSWFDHLTFSRHLRRNPARYGLVELDAPCQPTQPSVRPACANPDQYYFWDEWHPTRRVHQLAGEAMAARYAR

SEQ ID NO: 32606 - protein, 279 aa, Pseudomonas aeruginosa
HRCAASRLRRNVRQCFARLGRSAPSRYPVRLFPPPTGVDHDLAFRMRILWRQPRRFPGLPGSRRGTRPAPGRARPDPGLRWRRGRSDGHRGGRRIGRRRRSDRDHPAEPAGGRDRPQGPDPPGSGRRHARAQGAHGRAGRRLHRPARRARHPGRAVRGLDLGPTGLPRQAAGPARSERFLRSAADLPRPPGRRTLRPRRTPRHAAARCQPGGTARFPRRLDAKRGAEVGRPHPAVIRSSLRTAAAGSAGRAAGRSGGSRSTVAPGRHPRNRPRRSSGPC

SEQ ID NO: 32607 - protein, 422 aa, Pseudomonas aeruginosa
  UNSURE (97): Identity of amino acid at the above locations are unknown.
RSSCHPYRSPCARKESGSVREPPLAPERQAPALGPTTSVADSGKASTAPRICRSTASLSPNGVGEAVDNLSKKVRESRAAGPPRNRSLFDQPAVSRXGSTVTRTSGSWLPPPRITPRSGDTSRKIPPPGQGDVLQVGQQVVGRVEIHPAVLRAIQRDPGMRGVGADQSRLPGRRAGQQVAADVARRQSARAQAGEHQVGEVLADPATALQHFVQRRRHLGGLRIEGELAEDLLHQCRRRHQQRPSGREAVGGELGESPLDAHIGRLDAIAAGFQLGGGQRPPGKCQPGGDGFPCRRRGQLRRRMGEHFDLQSRADPQRLVGTLEGHPAQRIAECVVGILAAGLGPRLDQQLPAHDRPARRIRVARDAPVAATARPASHSGNGCRAAPGSGRPGAERSEARVRTSGGYRSLADIVDMGEIAQA

SEQ ID NO: 32608 - protein, 653 aa, Pseudomonas aeruginosa
PVEEVQRFAEVGACRIERLHVALQLQQGQPVLPGQAPAHLRRRPVQAPQVGAQARRPVLVEQRPQQAPFQRLAIPGQQADAAGQGQGAAQRLFVAIGIHVARQHHPQQARVVVATLGIAAVPEQVFHHPRRQVGILADQVAHAEPARPPRLAADRTLGQYPGVLARAAALHRHHLGIRRRGYAGQTAGHHPVAAVGGGDGEHAHADGPRLQADAGLAVAPDRRLGQLRQALRHVGLRALAQALAEGRQAGTVEGVAEQRFAALAGKGRLDHQVGQCREYRLECLRLAAPAGVERGQRQLLAEQAATGLRQEAEQAGRFQHPVAQRVGHQYAPLAYRLEQAGNAQRRVGTQFQRVAEVVIETPQYRVHPFQAAEGLEIEGGVAHRQVVPLDQRETELARQVEMLEVGFVETSGSQQHHQRRLAVAGGLAGEGLLQGAEIPGEMLHAQVAIEFRQGPRDDLPVLQRIARAGRSLGAVGKDLPASVGIARQVHGIAVQENPAGRPDAERRPEEVRMAEDQFAGQQPFGEQTLVAVQVGQQRIEQPSTLRHTSGDRLPLGGGQQVRQKVQRPGAVGALGIGVNVVGDAVLLDLPFHQGLALAQLLRAAALQLAEQPLPMGTHAALAIEQLVVGRIGERIVGKQLGHRRLAGLGLRSL

SEQ ID NO: 32609 - protein, 843 aa, Pseudomonas aeruginosa
RSRRRDAGAKRRGVAGSATTVLREDRDAPEAQDLCQRRQARAARRSCRGNALRRCATAGKVAAAHALRAAGPPRRSARDVRLARLLLALGEGRRLVLLTLAPRLTTVAGAWRQAGMLGQQLAGLLAAGRRRVLPPSALVFAGIRLVGRDQVVLAIADQVGAPHPLQRLAQQRPAFRVVVAQEGLVQAPLLVALDDGHAIALVGDLAQRVLARVIHSGGSGHRRRIERLDLVGAEAVALEPQGQVHHVFVGGPGMGGDEVRDQVLLLAGFLRELLEHLLEAVVGADPRLHHLVQRTALGVLRGDLQVAADVVGHQFLDVLGRLDGEVVAQAGGDQDLLHPRQRPGLAVQLDQRAVVGIEVLADAGEHAGWLAAVPLDVRALAGDAVHVRRRSAKVGDHAGEAGHLVAHLLDLADDRVVRAVLDDPSLMLGDRAEGAAAEAATHDVHREADHLVGGNLRLAVGRVRHAGIGHAEHVVHFLGAHRNGRRVEPDIHFAVLLHQGTGVARVGLQVQHAVGVGIEHRVVAHLLERRQADHGLLPGQPGVRQQLHDLGFLRVLLRALFLLDGAGGGVLGVHVGIDDLVDLARPVDPRGIDLEPALRGVATDEGGAAHVGDRAHQFALGQALGDFHHRTLGVAVKQDVGRGVHQDRAADLVLPVVVMGDAPQRGLDPAEDHRHMAVGLLAALAIDQAGAVRALAGQAAGGVGVVGTDLLVRGVAVDHRVHVAGRHAEEQVRLAELHEVVLRLPVRLGDDADAEPLGLQQAADDGHAEGRVVDVGIAGDDDDVAGVPAELIHLFPTHRQEGRRTETLGPVLGIVEQRLGGLHHGHQGVSLGMGGRENAGRGI

SEQ ID NO: 32610 - protein, 679 aa, Pseudomonas aeruginosa
AIPTFSLGIACRRPASKKCHHLAILFLYSIHRHLTRPLRQAPGRVIVRHPLALLAVIFLLLASAVSRAAPEFPAPPASGAWLNGSLDLLEDPDGNLAVEDLEQAEQAGRFVAAAGRTSVGLSRSAWWLRLDLPRREAVSGGWWLEVASASLHDLRLYLPDERGGFREHRSGEAVPFAEGRDHAYRHPLFRIPPGDGPLRVYLRSYDPGGNAFPLRLWSHDELLEYRSQGNLLFGMAYGLILALLLYNLFLFTSLRDRAYFWYVLTAASALVLTLSISGHGFEYFWPERAVPWWLDRLALLAIWGICVIRFSQNLLQSRQHARWAHHLLNACCLLFLACLAFNAAGWRWQAAGVLALTLLANLPIAIGLAVQRWRQGSATARLYLVGFGLVLGSVSLGVMRATALVQPTSANAMVFPLALTLEALLFSLALASRIQDLKQERALALDQADQEKNARLALLHSAQRDLARAVEVRTNELSEANRQLQMREAQLQYAAHHDPLTGLGNRRHLMEFAESALDDARRHGNSMALLLIDLDHFKPINDTHGHDAGDFVLQNVAQRLRHCVRTEDCVARLGGDEFAVLVGGSNAEQHARDIAERLLRELAKPVEFAKQWLVITPSIGVALFPGDALQFGKLYKAADQALYRVKGAGRAGYAMAADDERETAPALPWPTALAPERIS

SEQ ID NO: 32611 - protein, 455 aa, Pseudomonas aeruginosa
PPRTPGAAARSAWPGHSCGEWRKGRRWQRGDAWHRVLQLKRVPMVRRPPGKTQAGSFVLEVVHAGGKILEARVFADEGQAHRTDRTVTLLADDDFGDALELGLRVVHLVAVDEHDHVGVLLDRPGFAQVGVHRALVGSLLQGAVELRQGNHRAVEFLRQGLQRAGNLGNLVGPVVAAGAGYLHQLQVVDHDQRQVAVLAHQATGPRAHFRGTDASGIVDEQLLVVEQVDRRSQARPVLVVELAGTHLGLVDTPERREHTHHDRVGGHLQGVHQHGLVGAHHRVLDQVHGEGGLTHRRTPGDDDQVGRLQAAGLLVEVGETGGHPGQRLGGVEQVVDAVDGLDQDIADPYRPASLRSRFGDLEDLPLGLVEDLVGAAPFRVEGAVGDLVADADQLAQGGALADDLRVGLDVGDRGNVLRQFAEIGQARRPGPVVLPSPTAPERVTTSIGWLASASL

SEQ ID NO: 32612 - protein, 258 aa, Pseudomonas aeruginosa
SGRTYDDGRNVPCDWLLNTGPELLVSVIAIAVVVAIGAFSVIVRTLTTLATLVAAFFSLEHLGLLGDSFVATHDQVTDHGIVVTEVVFQLSQGLGAALDVHQNVVGLVHVVDGVGQLTTAPVFQTVDLAAVFFDGLGVTLDHATDLFALVRVNQEHDFVMTHKCSLRVAACRRTVRQGVNVFLACLVERRTNACPRGKGRHSREGQPAKQGRLANICTADGMARGRAAAAPHALTPAGCAGGGSRTGRRRWRPRRSGC

SEQ ID NO: 32613 - protein, 871 aa, Pseudomonas aeruginosa
LGLTFARPGGGRSVVGLRLGRPLAMLGRLARLGGSGGLAVLGLALRALARRNDLALLPALVLAADTRLGEQRLLHLATLAHVGVAEHLRGLRQQLRRDRRQRLHLAGLAPRHHRGVGTGQRRLQVDLGHGCALAPLRRLAGVRRLVAVALLASDRRAQHVSGQLEIDLPLVQVDPRHYHFRGVAETEAAPGAFAAEAMVHGVEMIVVAGQRGHMDQAFDEDVGQLDEQTETGDRSDYAREGLADPLAHVFALQPVGHVAGGLVGTPLGHRALLAQLVQAQFVVRIDTRLGHARRAGPLHVRSLRLGADHTADRTMHQQVRVAPDRRGEVGVGVVVEAEVAIVVRAVHRLAERTQHDRLDQAEVGAVVDLLQQLLVVARGRRGLAAAEAQPQLAEELAQVVEFLLRRAVMHPVQRRDGVLLQEACGRHVGAEHALFDQAVRIVALGRADFRDLPVGAEDDAGFLGLEIDRAADMAAGQQRFIQRIQLLQVRHHAGQLLAQVLGLDAVGMLEQLADLGVGQAGMGVDHRFVELVAGQLASLGQGHLADHGQPVDQRIQRAETIGQHLRQHRDHPLGEIHRVAAPGRLFVQRRTDLHVVRDIGDRHEQAPAAAALGLGVHRVVEVAGILAVDGDEGHLAQVDTLFLVLLRHFRLELGRFLLHRGRPDVGDIVAAQGDFDLHPRRHVVTEHLDDLALGLAVDARPLLDAHLDELVVPGLAGLARRDQDFLLDLRVVRDHHADAAFLEVAADHDLVGPLDHLDQLAFAASAPVMAGHPGQGAVAVEHQAHLGGTEEQVVAAIVGDQEAEAVAVPADAAADQVQLVHRRIGATTRIDKLPVALHGAQATTQGLFRLLAGEPELVEQLGASRRSAPLG

SEQ ID NO: 32614 - protein, 147 aa, Pseudomonas aeruginosa
RTTAAACSVSRSTILPLPSSPHWVPRTTTFLPITLVPIVEVRCRPRPAESQDASGATCQLPSRSASCRSQPASRAEAASCPGRAWTTRCPSRRSRCTACQSPAPSAGAQIPDTAWSNRAWPRVTRLFRSVEKPVAGRARPKSAPISS

SEQ ID NO: 32615 - protein, 205 aa, Pseudomonas aeruginosa
FLPDASKSAFSALCRRRRSLIDTPPRRYTSSARISRCGSLGWMRAADSGSTSASCRCSASQPLDRASASIAARTSGSAPGMSARPSSQRLVIEHGAPHQQGNPAARGGLGHRRQGVGAEFRGRIALRRIADIDQAVRIARQQLPGRLGRTDIHAAVDQRRVDADQLAGQRIGQRHRQVGLAGGGRPHEKDGGRQGRHRNALGQSA

SEQ ID NO: 32616 - protein, 423 aa, Pseudomonas aeruginosa
AATPAHPCRRTLQHALGQAHLALRAELAGGSAGRTRLGQAGRPGRRELVVGTDLAQRTMQGAIEEVMDHPAVTEANFVLGRVHVDVHHRRIDFEEQHEGRMPAVVQHVAISLAHRVGDQLVAHHAPVHIEVLQVRLAAGEGRQADPAPQVQAVALDLDRQRLLEECLAAHRADPARAGQLVSRLVQGEDGLAVVAQVESHVEAGQRQALDDLLQMVELGLLGTQELAPRRGVEEQVANLDAGPHRVRRRLYPRLHVAALGFHLPGFAGVGGTRGHGQARYRADRGQRLATEAEAHHPLQVFQLADLAGGVASQGQRQVVGGDAATVVAHSQQLDAALLDLHINAPGTGVKAVFQEFLGHRGGTLDHLTGGDLVRQPRTQQLDTRCFTHHWAARAVLGMDRAWPTFRLSLDRLLLLRSAAMLTS

SEQ ID NO: 32617 - protein, 153 aa, Pseudomonas aeruginosa
WLALASLRDSLTFEMKPVSTRIDGMSGDFSTMNPACSTRRLCSEVMRPTLVSTLWPTSRLDERVAVIDRSSSTPASIWSLSPRLTLPSPPIRSERFSLSASQRAVSEVAPRSDRANTEAPKALRLGAASAWIETNRSAPFLRAISVRLRSGMK

SEQ ID NO: 32618 - protein, 146 aa, Pseudomonas aeruginosa
CPTARHPGRHQPSPDAPGNRRQVVRPARRPGCRRPSAPPPPGSDTPVPAPPPGDPPAPRRSSDPTGARPRRDAASESMSAALLRPVPGPAGSTRRHPRPAATVATGQRSAGLRPQGALAKTGTEQQHAGAFGKGPAVGSPTPRHGP

SEQ ID NO: 32619 - protein, 142 aa, Pseudomonas aeruginosa
SLPPIPRRCRRSSRKEYPPPAPAGRRRWPGGWPAQRARARHLPGRCRAMHPLLRPRARRTRSRAPPRPRSPARRHAPAPRRRQAAAAPRPPAPALANPHVAPAPRSGSRRQHCCRPRRAPSAPRPPANGGARHARRRGRRAA

SEQ ID NO: 32620 - protein, 439 aa, Pseudomonas aeruginosa
VRSPACRQRSGAHPGRAPGRRNRGRVAGRRAGRSWSSDRFGVRRAVWQNYTYPMSLSLVFVASHDSPTSGRQPFPAGPRPPRPVHQGLGPRAGVPAGRYQRRRAGRARSAPAALAGGRLPRRDGLHGGARQQALATCRAGSRHAAGDLPAHGLPARRHAHGAGPRDTGKSLRLALRPRPRLPQADPQASATTGRAHPGRSRPVRFPRLRRQRAGAGKGHRRTGRPRLDRQEHAGAQPQGRQLLLPRRAVRRHAATRRPGDGQRALRTLLGLPGHLPDRGLRRPLPAGRATLHLLPDHRVQGRDSAGAAATDRQPGIRLRRLPDRLPMESLRPPHRAGRLSAAPQPGQRRTRRTVPLERGGVPRPHRGFAAAPRRLRALVAQPGGGAGQRALDHPGAGGAEGAPRVPFGAGPRARGMGPAAPRGNLAQPAPTARPGRIRA

SEQ ID NO: 32621 - protein, 553 aa, Pseudomonas aeruginosa
GGGLLGSLLLSVASRKTIVRILEKPVRRLADTEPDTHDRPPRRLARRARPATPADPRQPLCRPARRAERQPPLAARDRRPVAGQPDAGVVHPARGQSRRERPRQPRGKPGGGPQPPRPGAREPTSEDPAEHPGCGDAQGPRADAADQPARHAAGQRPVRRAPGQALAGNPLGQPADHGSGLGAGQRPPAVAGAMAATRAGTGRTDPASGARTARHAPAADLPGAGRTLAATAVGHPGLSPARLRPSPAGSSPAYRPRPSVAPAPATATRCPARSRPLADPAGQLHSPRQWPGHRRAPELGRAAHAALAAPDRSVPGPAADRSPAAGAHARRAKRAPARPAAAVASGGGLDLALAGQPLACRSGAPAAALGGSPGRVAAALRRVAPRAQPVQQRGAAHRLCPRCAARLRPAKDAAAGGRSHTGTRAGAAERRTRTGPGEIATGDCQQPAAEETVPAACPAAHRPEQPGPVAAGPRRTLAPTVPRTSPAAALAGQRLAGGDAGPGRPRRPAVQRPACPGLRQDRPVHRARDPAVRPPAPHGMRDMPGTLVGRAFR

SEQ ID NO: 32622 - protein, 282 aa, Pseudomonas aeruginosa
TAALLQPGGTRMSVFSDLPLVIEPSDLAPRLGAPELILVDLTSAARYAEGHIPGARFVDPKRTQWGQPPAPGLLPAKADLEALFGELGHRPEATYVVYDDEGGGWAGRFIWLLDVIGHHHYHYLNGGLPAWIADAQALDREVPAPVGGPQPLTLHDEPSATREYLQSRLGAADLAVWDARNPSEYAGTKVLAAKAGHVPGAINFEWTAGMDPARALRIRADIAEVLEDLGITPDKEVITHCQTHHRSGFTYLVAKALGYPRVKGYAGSWSEWGNHPDTPVEV

SEQ ID NO: 32623 - protein, 290 aa, Pseudomonas aeruginosa
GMSFKDRLFICSQYLLPHHLLSRLIGFAADCRATWFKDRLIAWFARRYQVDMREAQVEDLQAYEHFNAFFTRALKDGARPLAQEPGAVLCPADGAISQLGPIEHGRIFQAKGHSYSLAELLGGDAELAAPFMGGDFATVYLSPRDYHRVHMPLAGTLREMVYVPGRLFSVNQTTAENVPELFARNERVVCLFDTERGPMAVVLVGAMIVASIETVWAGLVTPPKRELKTFRYDEAARAPIRLEKGAELGRFKLGSTAIVLFGPQQVAFNDGLGAASPVRMGECLALPKQS

SEQ ID NO: 32624 - protein, 713 aa, Pseudomonas aeruginosa
PRRGGAPRAPPSRLSPPPEPPGGIVASEGCGSISMLLEFGKVLSSLCRPLGQESGLPHSSCSGHDDEPASRVKKEEAQPRRSEVRHLSGASSPRRSLFSSGAVYPPMENQSPHLSLRVPTPTQQNLSFCDATPKDIKYWLAHLPKANLGETARQLYQGLIELNQLVLPVEARLQLLELFRPEVHFVCAHLERHFLNQAIVLDERPRKIANLCQALQNHLAIGYKLIVVQEAPRNSRDRAQLLAVGIQRAIRSLCGPLIRASQLYCPVPEGLWLELHQLYQLASQRGVHRLAVRDELAKHTPGLSVEQAYLIPLLLGCARCNQMRQNNIARLAEVLEPWSQLLSIQSATLPGSLFIAVPQIDGPPRYRSLYPETQLANALGIDTQPLVELIREYLLQPEAERAKARLPLIEGVTLDLLQHLSSAWGDIAERTFQRTQGQGQLTLCIGMSALHYFLAGRRPFNEVLQIQEAPEAPRFKADVQDAWAGAFDAQKVTDWQPGMPLEEIEYRPHQSPRSVQPGHPQAHAQADATEDYPTYALPIVNHSPGGYCLSWPKEVPAQLQAGELVGLQDLPGQAWSIAVVRWIRQVRNGGTQMGIEMIAPAAQPCGLQLLRKTEQSSHYLRALLLPAIAAISRPATVITPRLPFQEGSRVQINLHGEERRAVLNRRQASTGSFSQFEYRSAEPVNTPSDKPVTAPVARPPAGEEDFDSLWKSL

SEQ ID NO: 32625 - protein, 562 aa, Pseudomonas aeruginosa
RHQLSEAGQATDPGPGHPALPGGDQPVRLLAEPVQRAEAPDRAIHQDRWFLRPGPQPGGKPGDPQGPDRRTARTAEAQHRPLRRERQRPRHPVASRRHLHPGLLPAGAEPGDGLRLLLGRRMKNGRPGRPLLFRSTDLVRGCRAGKRRPPASGSSFAVAVAEQVEDAVQAQGRDRLLGRLLDQRLGAERHAQAGQAEHRQVVGAVADGDGLLQAQAFLRRQFAQQVGLALGIDDRLDRHPGDLAVDDLQLVGEHVVDPQLRLQLTGEIGEAAGQDGGLVTQALEFGEQGFRTLGQTQRGADLLQHVFRQPLQQRQALLEAGAEVQFTAHRPLGDRGDLLADAGGLGQFVDDFRLDQRRIHVEHRQPAVAAEHAVLLESDVDVQFLGDAEEFRTQRRRIGRFAAYRELDAALALVGGHVQRHAPGETVDVVDVQRVLGGDRADPLQLLGSHPAGEQGHDVPRLALAVDPLPVVLFRDRGEAHLLVQLVGGEQHVLEDRGTGLGIRDFHQDAERQGVVDHRLADVQDVHPALGQYAGDGSGETGAVFPGDVDQDNFAQGVSSAR

SEQ ID NO: 32626 - protein, 194 aa, Pseudomonas aeruginosa
SGQSGPRRRTAERAGRPGARPGRAPGAGKAAGAGAGRSTAAAELRRHPAGRRRSRPAQPQGRGLGLRGRRHSAGRRPAGRDQAGGIHLHRRRPAGPGRLRRERSRSRGTARSARRCARTATQCGAGDPARRPGTVAPVAAQPPGGSPATLSRLPGTGRPPVQGQPAHAQRRRQPDSLPQPRQPRRLPDQRALLR

SEQ ID NO: 32627 - protein, 292 aa, Pseudomonas aeruginosa
TDACARPCPADRGRRQRHHLATATGPEPRRRPQRTDPGRPAAQRNRAERPRPQPAQPQPAAGRTQHRRRRGGPRARPYPRHRQSGRSLLRRASAGAVSVDARAPTGAHARPRPPVTTLITHPLPVLAVGLALGSRVIPPRLLLAGMLAACLPDFDVVAFKLGIAYHDAFGHRGFSHSLLFAAILGALAALACRPLHSGPLKAGLWVALATASHSLLDAMTNGGLGVAWFWPWSDARYFMPFHPIAVSPIGLSRFLSERGLLVLQSEARWVWLPCLLLALAGMALRFLLRRSR

SEQ ID NO: 32628 - protein, 480 aa, Pseudomonas aeruginosa
RAGSVEGLRGAIIEGFVGGLQPYLVAFGTLQARDFQFGQRRHVVLGEFPGLAAVVVGLRAQVAVEGAMRGDRRIDQDRRQAMALRQMGRIVATQGAADQHRSPELGDGPLQLGDGLPWVMVQGRDAQAFGQAQVAEGRLQLARLVRFGRTVEAVDIQQGWAGRSHRERANGLQLGRESRTVPASRLHLPACAPIGNDARGRGIPRPGGMSVSGGVVVHFEDDVVDPRDPRFQAPVVVQAQPAVARRQAVEGEVAAAGGELHAGGRRGQQAQRAALAVELLVNVPPQQATHLRIGCQQVEQRLRVAQADGVHPVAADRHRVVMEGNQQEAFAGAVDGTPQQVELVVLEIARHRAGNARVEQHHAPVADVDDLLQQVAALGRPLHRLAFVVVTGEPAQRRGQRRAQPAEACVGIQAAVLGDVAGGEDQVDPRLLPGDPLDHLFQAMGGVHAEQARAVLGEQVAVRKLHQQYGGVGGGSVRMA

SEQ ID NO: 32629 - protein, 341 aa, Pseudomonas aeruginosa
RRGVRGEWGDYGDRRKWRQTRKAEQITVARTTFGLMPFNWPFACNRSALGHRHHLVAAGQAVGEPLAEEQVELVLLVGLVHRLVRVGIDRHQPPRLFGADHLGHPCIVVDPHFQPRRRQPGQAQFLAHLQGGGVRAGLGHFQRQDAEQPLPFAQRDPARGLCLAHVREQAHEPRVVRFAGRLQAGQVDPVALAQQVQAHSPRTSARFRASHCRAMMLAALLIRPSRTACSASSNGQTWTRMSSPSSGKPCTPPTPSLSQRPTNRCTTSSVPPGDGRYWVIGQSAPRVSPASSIASRWATSSGCSSLSIRPATSSSSQGLASFCIAPTRNCSMSTTQSRCGS

SEQ ID NO: 32630 - protein, 515 aa, Pseudomonas aeruginosa
PPPVATLALPHLASFPGRTNAAQTLPGGRRGRCYRCRLGRPADPAADQDRPDQRLQGSRRQQRRPRRRPGRLPGAQGSGAPGPRRPAAATRRRRPRRRHPDRIRRASGDRQAQQPGRPGHPQPAVVPRRPLVPVAGRQGNQRPGPAGILRDPAGPDPAQRRDLLHGAPRPGQPGHQQGRGSRLQAPAGPGQRALRRGPFRQDRRARGPGQLRHRPRQPVDRRTARGRCLPGPGDPDQPRLQRHRGHAPHPAGGAAGAERRQGLGRHRGAAEPAPAGQQLRGQRRRGNPPPAQGRAPADPRCRGPVPEGRQRRPRLRQQRRQSAGALWQVCRRAQHWPGTEHPDLQRRPDLLPGPRVLPAPQPERAIPRRPAPPGGAGYPQPAPRGEYRRRAGPGAAPGDHLQPEFAGSHRDRLPGRHPQHRRRAQRPAPAVRRRARLQQQPLRLHPRYPAPEAGGRHPQPGRPGGAQRLPEAGLRSGQGLPPAGPGQGRRRAVTEQAAPAVLARAKTPPVGGVLA

SEQ ID NO: 32631 - protein, 589 aa, Pseudomonas aeruginosa
RIAVRCGRGRSVRSSWFPNRGDRPHRSRPRGSGLAEQLGGAQRNAPTGFAQRFGAQHQAEADVTGGARAEGFAGEHRYAMAVQQAVGEGLGGKSGGTDVDHHEHAAVRAQWTQAGAVGQALDYQVAAAAVGLAHRLQLRQRRFQRGAGGILDEFRRAIEHAQGEVLQVRAECCGTDHPADPPAGHGVGFRQAVEGRGTVGHPRQAGRADMLAVEQQFAVDLVGDHPQVMGHAQLGQGFPGGPRQAGAGRVVRAVQRHRARARGDQCGDLLGLHAEAILGAHRHRHHPRATGAEHRFVGDVHRLGDYHLVARIQQALHHRVQRALGTCQHHHLLRVHRLAAAPPVALGDALAQGALAAHVGVVGVAGQQAVDGRLDDGRRGIEVGVADRQQEDFLALLDPRQRAIVDVPGSGAVAGDTLSEVGIAHGCSPCPAVSAHRRAAVRSGSRRAARSRRAGRAPVRSGPAAGAPRNRRRGPAGRSRGCAAARRPARCPGRACRRGSGRARRCSTVAPPADCPVPRWRWPVPARCRGSRHRRPAPGPGAAGRRAWRRCRPAGRSRGCRSRWDAASCAALGWRTRSCRYRPVGSCRC

SEQ ID NO: 32632 - protein, 554 aa, Pseudomonas aeruginosa
RGAVQVVEQAVAVRAEQRHFAGGGQQPALHGQALFAGFGEAGGIADRPAGAFGGERGDRVEGQFAVGGDERRVRAARQVGDAGHAGYAFEFGVLRIDQPQLAGETAFGTAFQGTRHATAANEGEMPGCQQALEVFTIHVGSRFGTWQPSPLPWRKRGARTSTQQRPQQFAGNDVPLDFRSALPDPFDPRVAPDALDRSFIHQAHAAEDLHRFVGDLAEGLAGEQLGHAGLAVGHGALVHLPGGVQGHQLGGTDLRGHVGELEGNALVAADRLAELLAIGRPAQRQVEGALGLADTVGGDHHPSGGEPGVGHFPALADLAEHLGGRHPAIVEEDLVGVVATVAHAFRPAAHGHPGRALVHQEGGHRVALAAVVLVAVGDGEDDGEVGVPGVADEVLATVDHEGVAVAHRAGLDRIGVGAGARLGEGEAIGLFALHAGQQVVAELFSGAGHEDLRGPRDEYVEGPGDLRQLAFDQRLGQVVEAAATHFLGHVEGIETGGEGLAANLCGQLRRHRVGAVDIVLVGQQFLLDEAAHRLDQHVLFLGQPEIHGNHLLGA

SEQ ID NO: 32633 - protein, 418 aa, Pseudomonas aeruginosa
ASTAPAGPPWLMVTPEPMNRPVPITPPRDSMKMWRLARARVSCSLSLPSAMAHLRMRVRTGVFEMAHYSCLHSVRGRVLRTDERIIGGGCKTPLNARIEDVKSCKEVVRRAAQPAAESASPRKPARRRASAPSRRRLPRRAPQARGSTPAAPRASRSSSPRPAPSATRPMEWQLPDRRWAMFAASARSAWSRASASSGNCSSRLPSRLPSSPASLCRPSRRRWVSSICRSSAASTASAGTLVPTSPSARRSSSIRRGLPSTPCMPAAKYRRTMSGWMLAVKAKIGVERFRPSSCRRIPAQSSRPAIPGRCMSSRIRSKRRCRHNARAGPASSASITRWPSRSSRPWATSRLSATSSTSSTSSADTDAAGGVAPDKLASASSISNQNVLPWPTRLSTPIRPPSASTSRLLIARPRPVPP

SEQ ID NO: 32634 - protein, 226 aa, Pseudomonas aeruginosa
TCGSSHRSSRVAFSRARGSSRVRTSSSRLRKEKSTASGTSGASSSRAKWRTSLRIASSPSPAVASARRRWRSRSPSDASRSSSAMPRMPFSGVRISWLMVARKRLFARSAASAWSFARRRLAVRRSTCRRNSSRSASRRRRSVRRAWRMSSRAAATASISSRSRSTLSSRSGCCRSPSAICPANSDMRHRWRVTRLWNSQLRATARPQRKLPIHKRLARPPETSRR

SEQ ID NO: 32635 - protein, 319 aa, Pseudomonas aeruginosa
PLRISSRRASISRISRRYSKNSCTAPARTVKHRLNSSTRHSRRRANTPPWPLTRRPRGCRRGADSRARCRPANAGCCRRRDSHAGPGRSRPSSPPAASAARPPPAGSPPSAVRAAHGCSRRRPGARRTACRCAVRGRCSRCAGAPACRSSVGCRKPIRRCRGGRRSGRSPPRSFRRTTARRDSRRGRRGIGCAPAAGGCRRSPRPRAAPARRKTPGRDRARACGRPVSGRPVRRRRRAGSAASCPAPPPRPGSPARRTAASPAPAPAPGPAGRRSRRSAGIPDSRNSGWSPQPVPGRPAAIRRAPASRPAWLRRRWPRR

SEQ ID NO: 32636 - protein, 135 aa, Pseudomonas aeruginosa
TAARMATTATSMPACVSSAKCWRRCARPPPRTSSSACACPPTSATPRVSAKASRCRRPRRSRASWTTCTSSPALRPPSAAPFISSRRWPSSRPTWPAKPVPSRRAWRSRCSSPGASTSPRRPRPSSPEARPTSAA

SEQ ID NO: 32637 - protein, 374 aa, Pseudomonas aeruginosa
PGPAEVAHQQLGHGIEAVQPPDLRADLLAARIAALLGHDQKLPVLCQLAATDPLQPGQRVAGTAHRDHLDAAEAPPLQRLRHALMVEQQAEVSLLLEQTTGDVTLAAAGHLHLQTGKALRQRFQAVQHRLVGHRLVLGQAQPRLLAARQPQRAPLQALALAQHLARLRQQHPALVGQARLASAAAFEQGDAEVRLQQRDAVAHRRLHPLQFAGGGRERLALGDADEQADLLQVPLHNLSPIKIGNDFIPSAGSLEWPQFPEDPAMTNYLYLSIAIAAEVVATTSLKAVAGFSKPLPLLLVVGGYVLAFSMLVLVMRTLPVGVVYAIWSGLGIVLVSLVAMFVYGQRLDPAALLGIGLIIAGVLVIQLFSRASGH

SEQ ID NO: 32638 - protein, 353 aa, Pseudomonas aeruginosa
  UNSURE (202),(207): Identity of amino acid at the above locations are unknown.
GSPMPQALSTDILIVGGGIAGLWLNARLRRAGYATVLVESASLGGGQSVKSQGIIHGGAKYALHGALTGASEAIADMPRRWRACLGSDGELDLRGVRLLSEAHYLWSPGGLAGSLTSFFASKAVRSRVEQAKGEDLPPALRDKGFKGKAYRLTEIVFDVPDLIRRLAELAGDSLLAGERIEPLRECRELAGLCVYGRENRAXRVVLXAGGGQRSAAPRTGPGTTGHAAAAAAHGDGQGGDPETAVRPLPGGRAEATDHRDHPSDPRRPVGLVPRRRHRRSRWRGPRRSRADRRSASRTGKAAALDRPRPGAVGHLAGGSRRAGTVQPVAPGQRLPRRTGTPAGRLADQAGAGP

SEQ ID NO: 32639 - protein, 310 aa, Pseudomonas aeruginosa
LRRPGLRPPGRRRHPPQRTCRAAATAASAARRTGLGGGLRMIRDTLHDLHRPLGDTGLAVSPLGLGTVKFGRDQGVKYPSGFTIPDDREAADLLALARDLGINLIDTAPAYGRSEERLGPLLRGQREHWVIVSKVGEEFVDGQSVFDFSAAHTRRSVERSLKRLETDRIELVLVHSDGNDLDILENSEVYPTLAALKREGLIGAYGLSGKTVEGGLRALREGDCAMVTYNLNERAERPVIEYAAAHAKGILVKKALASGHACLGAGQDPVRASFELVFDQPGVAAAIVGTINPLHLAHNVAMAAQALKKA

SEQ ID NO: 32640 - protein, 312 aa, Pseudomonas aeruginosa
PDKEPRMPRMLARKDPSAFKTLPLLVEASPDGLVYQALGLPLNFQQMLVRRRRMEVADPQRFVAELANLGVSVRLTLNWQGRDYWVLVRQRRLDRGDTVLKLISGYVPAHELNLPLLTAIQEVAEECLVETAGGWLGGRFGDTWLPTPYQGSLRYRENSHFVLTPLSGAARPVQAGSLRLLERPRAYVHLPTASLQLVYDMRLELPRDAREPSLYHVDERLESGPLVARLDRRRPDLYLLPLDQGRPTGDLFTLRKGQLRPAATRGLWLAESFAVQDGWLVHEERIRFRDWLALWPSSNGDQAGGGRDRASA

SEQ ID NO: 32641 - protein, 876 aa, Pseudomonas aeruginosa
TGRALPPFLLQLAGRLAEQAASDDEQLDLLGALEDVEDLRVPRPLLQQLILGVAEGASQLHALQGDLVGHPSSLGLGDGRFLRVGQLVVGHPCRLQGQQARCLPLRLQAIESGLGVADGQQRFPVVELAASLLQQFAGPVQRRLGHPDGHAGHQRAGIVEGLHDPGEPLLHVDLGVAQQVRGRHPAIIETDRSGIRSLDPELLLQTRHGHPRRALLDHEGLDRRPPQVAVQGGPDHHGIGPLAGSDENLLAVQYIVVAILGRGGANRRRVRAAARLGDRHRRPGAAEALQLLLVGHRGDRRVAQPLARHGQEQADVAPAQFHHAEQCRQVAAVLDALLYLLAGALARRGRADSLGRAAVHAVQQGREQVQLLRIGVFGLVVLARDRPEIVFRDLMRLVGQAAEFLRGFQVHVDSSFTRRGGPRTRSGSQVQAAGHQRYRAQVAVPALGRMLLGEAVAAEQLHGVGADLHRLLGAQQTRQVSLALERLAALGQGAGAPDHQAHGVQFDGDVGDHEGDPLAMADRLAEGLALVAVGDHVVQRRLPGAQRQGTPGQGRVIEEGPVVEMLGGQAVVRRHLDALQAQPGGAAGLQSHRRLGTSLDALGGGFHQEQRRPLVGLRRDDQAAGLQAAQDQAFLSGKQVVTALAPGAGRQFLRVEQQTRLVDRDGGERRPLFADERRQPLRLLRGAAPAADAVGRRQRHQQGRRQRQVALGQGLGDKGRGHRGALTGHAAVHLADPIVGQAQLQRLVEQFRRQAGLGIRVMSQRTQHLQGEAFEHVHQHLLVVGERQVEQPVRIGLARSLRLLRRTLAGQAEAGTAAAVEQFFEGFAKIEAIRPVGLGDTVQYSQGTALYIGAHGHLAPRRMGCPDHAPPHGQRL

SEQ ID NO: 32642 - protein, 103 aa, Pseudomonas aeruginosa
RRPARPARPARRCSARRWRRRRGGPRAVRRGPPAPGPPAKCAKSRHANSGRASHHRPPTPGPGRNGAWTTSWELQTTSRGRRPVYQPTGAGACSSSPIACSRA

SEQ ID NO: 32643 - protein, 607 aa, Pseudomonas aeruginosa
QRRSAGSRWSWGQGTASARRVLPQAVSPQAPDFLRSPVPLCGALRPQCQRTGAARHRLPEGAGRTADPTYPARRGALRAATGADPPPTRPQRPGVRRYSPDATGRADRRAARQGGVLPLAAPGQRGAHAGRPDGPDRHRRPCGSSARRSAPPSAFAISSTCCATNRIEPGSSTTASTWCSRPISAAARSTGHSSSSSSNCNWIEQGMFAATRLTRLRHDTSRILSHWILPLGWLALLTGMFWVGDRSDYHRLFYILLAAPTLLYVILQPRLLRPLTGSPLFIAFLAFSSYMMLSLSWSTPENSTGSLLKRPLYIALLFFCAAILALEAPLRLKTATWLAALGAVISAAATLLQYYWDANPLRLTGYGALYNPLLSAHVYGAFTALWLAYWMQSRPILAPLPLISLALLGGLLIATGSRTPLVGLTAALMWLVLAGDRKKALIALALALAGALLGYILYPEVITQRGASFRPEIWADALRQISEHPWFGHGYDHPMRIVLSNGMLLADPHNIELGVLFAGGIIGLLLWVAIYALAFGFSWKNRKSPAVLLASTWLVFGLAAGLTEGNAFLPRPKEHWFLIWIPMALLYALWIQQRFAASRRGEDIAAP

SEQ ID NO: 32644 - protein, 149 aa, Pseudomonas aeruginosa
PSPADHGSRDGAHATGSVRRPAGNAGRAGESGPRPAARPVPSGSGSASRSPHVRKPGHRPPRHLPAAPRVRGSAPASQRARRCQAPAYRLRAAHRRLADGHPPGVPAATRPLPRNGSGSPRPANRTGDRRTRLRGRPTGPRGGSATTRG

SEQ ID NO: 32645 - protein, 468 aa, Pseudomonas aeruginosa
ARPWTTPGGGPRSGSPQPVRQRSPNPGNAPGFQPFRRAARPPAGGSRRCRRNAARPGRRSARPLRANRVRGRRATCSACRLRSEAGNRRQAPEFAAHRSVGEACLQALEHEPRTGLALAAVKRRQVGQALGQGRLVAQREEDADPFHHFAGAATGGGDQRYTGNHGLQQDHAERLVVGTQGEGVERLEVAPCLFDLAEEQHALADTQFAGQVLELLFQAAAAEDRQQAVLRQARQRGGKAAQQGSLVLVRMQAADVADHPGLVGQAQLPARTQALDLLGLQRSDVDAVVERLDPLRRPLRQATADIVAHRVGHRQQAQALAHQAGEDLARQPLVIAEGVVHANDRQTSGQAGDPDRLEAVRDAEAEVARTGDLAQVADRLQLEATDVPGAVLEEQYLVGGATRRHLRIGTPGEEHRGDLVRGSGEQAGVLTGTVEERPVVAVTELQDARFSRPSHTSPRPPSRPGCPP

SEQ ID NO: 32646 - protein, 194 aa, Pseudomonas aeruginosa
PGRGGRTRSGGSSPGRSGRPRRHHRPPRGGIHAWDRSNHASVRRRAAGAPACQPPGESPGAALRPGRARTPARCPGPANRPGHGSGGSPGALRRPPAGRRTPPAGRECPAPGSARCCGTRGRRSARPADGAGCGSGGCSGASGSRRSRPGRGGRRCSSHPARYSVRPRRPAARPTGRRSCPDGCAGAGRGPARR

SEQ ID NO: 32647 - protein, 267 aa, Pseudomonas aeruginosa
SGEYRGIFQPRRQAPGPLPLGGAAPGQAHRPAALAHALGQFAPVGFRPMLGVPGSTVQEHQVRRARVGVGQLLAVQAIVTDRLGQRVVQRLGEQLARALHRMLSPGDRIGTAIEAAGERLARRVAIETGDRRLAHVAGQPGTLQQPLGVDHQVIVDFLQALLEAPPFAVAQGLPEVLAPAPDRHRDHPRHRRMPGGNLGETFLHHPVELDAGNRPGGVGKRRQGVDHVAEGRGLDQQYPHPATSAGSPTSRSRACNTRPGGSSRRQL

SEQ ID NO: 32648 - protein, 141 aa, Pseudomonas aeruginosa
ASCRRRTSSLAIRPARSSPSRMRMLSVNSSSAGCSPDQARTAYCTINSISTIPPASCLRSKAAVASKAFEAVPAAVARVPRLSRILARISLTSVRNASRSRGLASTSARTASKLACTRRQPASTRARTNAWCSQVQASCSW

SEQ ID NO: 32649 - protein, 234 aa, Pseudomonas aeruginosa
PKIRSMSDDRLSSTAPSLPMPRTTIRCGSPERRPIGVPNCSHWRRWSHSQARSMQASARADRSRQVSASAARRVRSRQMMRSCWRVRKRRRRRPSSSSSAQSSSRACNWLRNSPGAWGFSSSPRSARSSSIAGSRTACSATKSLAAATRRKSSRRSSGQASRRARAAASRAATAERRAVPARSAAGSRVAGRFASEGRLMVYPVWASDRRPQARRTTSKRLYIGPYSLTATIEM

SEQ ID NO: 32650 - protein, 393 aa, Pseudomonas aeruginosa
RHPTALRDHHALSQHHSGNPRSTHARRPVHGTPDPLPGALERPGDGDAGEQARPGPGRPHLHLRLLGDPLRHRLQLFLPGSHRRTRRRPGVLPGPRVPRRLRPGLPRRPHQRGTTGELPPGSGRQRPVLLSAPLADARLLAVPHRIHGPWPDPGDLPGTLHEVPGKPRLHPRRQAEGLVLHGRRRVRRAGIPRRDLPGRPRETRQPDLRHQLQPAAPRRPGPRQRQDHPGTGRRVPRRRVERQQGHLGSLLGPAVRQGHRRPAAAAHGRGHRRRIPELQGERRRLRARALLRRASGTAGNGQGPFRRGNLEAQPRRPRPLQGLCGLPPGGQPQGPADRHPGQDHQGLRHRQRRSEEHRAQREEGRRRQPARVPRQVRHPGQGRRPGEAAVLQA

SEQ ID NO: 32651 - protein, 508 aa, Pseudomonas aeruginosa
RRQRRGQVPGRAPRRAGRLHAGAPAEEHERAGSAAGNPEGHARRLRRSRDLHHHGLRADHLAAGQGQGTRPAHRPDRPGRGPYLRHGRHVPPARHLLLGRPALRAGGQGPGDVLPRGQEGPDPRGRHQRGRRHVQLDCRRYLLQHPQPADAAVLHLLFDVRLPAHRRPGLGRRRQPRARLPDRRHRRSHHAERRRPAARGRPQPPAGLDHPELPHLRSDLRLRTGGDHPRRLAADDRRAAGHLLLHHRDERELRPAGHAEGRRGRHHQGHVPPRGGQEGSRSPRATAGLRHHPARSRGSGQAAAQRLRHRRRRLERAELQRAASRRPCRRALEPPASGPEAEAELRRGVPGRPSRPGDRLHRLHEALRRADPPVGSLQGVQGARHRRLRPQRQPQEAAQLLRSGSSLGGAGRARSAGRSRRYRAESGGRGHRQVRDRSGEAQPAGLLIRSILLSAARGFEHAGAANGRRRLTTNQGPKVFVLRAAQRWWHVKGEECERTHSRTRHRQR

SEQ ID NO: 32652 - protein, 481 aa, Pseudomonas aeruginosa
RSRHRRPDPQAEGGRRRSGSRRATGSRSGPGRGARRRAEARRGGPCASQGRYPGSGRRTQPRRRQGPRRPGGAHAGARVRRRAERSESQRSQGSHPQGRRPGLRQGATAARQVRRCRRHRRSRHPADPGSRLQQVRRSGRSGDDPPDAGRRRQPASQLAERAARDPVRPVGHHRHGSLPRCPEGRGGEGRGQADRTADPAQGLRPPAQGTAGLQQFAGPQRQGADPQEVRTHRLRRGHSGRPAGPGDPRCRPEEPPATGRRGRRAGRQGPQQEALGRCHAGRLLHHLQSRPHRRHRLHADRQRAGSGDPRCVQGDHAAGMGRQGLPAAPDAAAVAVLRPSRDQRRRRGALHQAPGRAAGGHPHPAPVIPAPLPTERPAPLASMPRSSLGPTGWWGFFCPPDGSAKLRPVVPPANATGPAGASSARTMTGARRQPSRRSQPYEKQGFSSGTADLRPSSGFFPDTLNLGPAGPIQSYLSDQSA

SEQ ID NO: 32653 - protein, 304 aa, Pseudomonas aeruginosa
CTLCLHPIETGRGLPLAQYLESASHEKSSRCRQPFGGRGCHAATRAVAARAAAFRAAERAELGTAVPRSCLRAPARAAGDYPLRTARCALRQPDGTRGPPPPARADPAATGEAPALPGELQAAHTQRRADHAGVRRSLPAAWPPVAARLPDGRGASGERRAQRTVARPGIAEPAPEGVPGPLPALPGRPPATPAALAHPAEPDRPPGPPSLPVQRPAAGSRATDHPGRLRSLRHRARRHLAPARRPAPGSGDRLPPRPRPVREAPEHRRQPLPRLPRGGTQRARHRRPQRPSATHAPRNSTRTT

SEQ ID NO: 32654 - protein, 137 aa, Pseudomonas aeruginosa
PTTSASTKTSRRTSWPSSTSRNSPTATTSPAWPTGTISSAPSRNAWKAAATARSACCWWTSTTSSGSMTASATRPATSCWSAWPGACAVASATAPPWRASPATSSPCCSTTPRWKRAKALPRRSCTCSTSRCSSTTS

SEQ ID NO: 32655 - protein, 145 aa, Pseudomonas aeruginosa
STPSTRPRRPRPWPAGRASKPNWRKPATTASPPRSPTSRPSTTPRPTTSSTWRRTPTATAAWAAPGCACRPDDYSATSQSRRQPPWLWAMTSASQGSRSRSSSSSGHGGLTMASPEPLKRSASSIGCTCSSARSSFGATLRSRAW

SEQ ID NO: 32656 - protein, 341 aa, Pseudomonas aeruginosa
TRWHPGTACDGRCLRRAAPRSPFAEVVMSETLLSSRNLAFELYEVLDAEALTQRPRFAEHSRETFDAALGTARSLAEKLFAPHNRKGDEHEPLYENGSATLIPEVKPAVDAFLDAGFLNATRSFEQGGMQLPTLLSQACFAHFQAANVGSSAYPFLTMGAANLIESFGSEEQKQRFLQPMIEGRFFGTMALTEPHAGSSLSDIRTRAEPAADGSYRIKGNKIFISGGDHPLSENIVHMVLAKLPDAPPGVKGISLFIVPKFLVNADGSLGPRNDVILAGLFHKMGYRGTTSTALNFGDNGACVGYLVGKPHHGLAYMFQMMNEARIGVGMGAVMLGYAGYL

SEQ ID NO: 32657 - protein, 597 aa, Pseudomonas aeruginosa
NRPVASPSPCPAARRPTLDAVTVNNFFLIGAVLVGMSILVSSLSSRLGIPILVIFLAVGMIAGNDGVGGIVFDNYPMAYLVGNLALAVILLDGGLRTRVSSFRVALWPALSLATLGVLVTTGLTGIAAAWLFDLHWMEGLLIGAIVGSTDAAAVFSLLGGKGLNERVTATLEIESGSNDPMAVFLTVTLIEMLASGQTGLSWGFALHLVQQFGLGALLGLGGGWLLLQLINRMHLAGGLYPLLVISGGLLVFALANAVGGSGILAIYLCGLLLGNRPIRSRHGILHMLDGMAWLAQIGMFLVLGLLVTPHDLWPIALPALALALWMILVARPLSVLIGLIPFRAFHDREKAFIAWVGLRGAVPIILAVFPLMAGLPNAQLFFNVAFFIVLVSLLVQGTSLPWAARLLRVVVPPDPAPISRAGLEIHPTSEWELFVYHLNKEKWCIGAALRELKMPGGTRIAALFRGTELLHPSGSTILEADDILCVIGHEHDLPALGKLFSQAPDRGLGARFFGDFVLEGDAQLSAVASLYGLKLDGIDGEQALGRFIAHEIGGEAVIGDQVEWNGLTWTVAALEGNRIRKVGVKFPEGRPGPGLFL

SEQ ID NO: 32658 - protein, 513 aa, Pseudomonas aeruginosa
FPVEFPFRGALRRLGATTNLHSPFFESLLDHACPSLPDRYSFPRPLPCQSAAPRPVRAALGRGRPAKPRQAGRAQARRSRPEGRQGQPRTDPQVPRRARRSAAEPGGPEKAPERRAPADRGKPARTGAPEEDQRTSGQRTLQRRERGPPGNAAQRPHHPAGRVAESPGRGQQPVDHRRDPSGTSPGRHQQHAGTDPGNRLAAQGRQGKRQDDQRRPSRRAARRAGRIDRAEPAVAPGAGRQQPAAGPRQEPARSAHREDLAPGKGNPRPAGADQREAPRAVGKDRRRAVQGRRPGSRHRQPAEPGERQEPASLRLPPACHRPPQRAHPAQPRDQAATGQPDPVQPGPRGTDQRPARQPAAVAHPLQAETGAAQDQGRPEPGRRDRRPAPRPVRTEPGTRQAGDPAAIPGRPARPAAQRAGHAGTAQGSRHPVGNPFRVARTAQPRTQRAAQRSDHLAVEPETVAFHQREPAHHPRRADVLDSQQPAARPVLVQDDPDPAEEPAHRDPLGLRGA

SEQ ID NO: 32659 - protein, 742 aa, Pseudomonas aeruginosa
TGRRPGRSAAAVPAAVPADRRAAVETPLPVRQAGGAERRHRPLQARQPAAYPAGDPDHHPPRPARHPDLCRRRAGPAAGRPRPERHPRQRPTGNGPGLAAVLHRPSHPHPGRHRRAAFPLEPRTGRLPRPAPGPPRRCGPGAGRRGDGGRAPAGESGRRRDRHRRGPARLRGHGLAAQPPAVQQPRRRTSVADQDDRRHPLHRAAAGALRRGLLRLLLHLAEAHRPSHRYPLPAAALVRHRSRLRPRPGRGGPAPGLRPGPGETAERGEGRRRRRDQRRGADPRHRADQPAIAAADPTGPADRLHRLPVLGLGRPDQRDLLPRQRHPVPVHRRHRRSGHQRADQPARLPRGAGHRGGHRGPGAQPARPAGSPGTAAPDPGPGQRLRHHHPAFLRHQRHRHRQRPVHPRGQLGQAAMAGGGALGRPRFRPAGDLLQLRLRPDHPLRASGTNRRRGDHRQPVRHGQPDPHPRHHHHRFRPQGDHRPEPDLHHRATGELVAERYRDPGHHQDRPGLRDRPAAGAQADDAGGQGKPAGTARPGAAAVLPDHQRQYLRLRAALPRPRTGRPQPLYRRDPDEDRHQLPRTQDRHGFQPGRCVRQEPPGPAGPAVRRRAAAQRRRQSARAQGPGRSRRTDPLNLRAWTPSGNSQHNARELPEASLEITRRPRLRQPLRPPGRRLLHRSPARPHRRAAPGGSQPRRPGAARPASGNQRRSAVRRTVRRAQAVVGGRAAGDGVFRPPVRLL

SEQ ID NO: 32660 - protein, 416 aa, Pseudomonas aeruginosa
PAPGRRPRPAARRGDQPGRRALGPAPQGRRPDPLLADGRRARRAALVDPRVPRLRSPSGTGHSQQPGALRDRFEHAGLAREEGKRGDAAAPGAQPRALRSLRILLLHPPARPVETVGGVRSGTPLRRLQRSRAAIRGDVPPGRRAQRRTHRPLAGLWLLPRGDEHRQHVDPRHYLRLRALRLPRRFRRQSHLQPLRRRRPLLLQQPGTDRPLEPGRPGPGADATGGSGRTARQPRPVPAPLPGPLPRPDAPAPGPGRRRGERPGPGPGTVAAHAGQRGGLLAVLPPTRRRNSGAGAGQPARRLRRPRGLRPLGRGLPPARRGRRRRPGVAAPAHARGQSALCAAQLPGTAGHRSGRAGRLHGSPLAAPGAESPVRGTAGHGALHSAPAGLGAAPGNQLLLLTGCPDRTAADNAAME

SEQ ID NO: 32661 - protein, 430 aa, Pseudomonas aeruginosa
PVHPRGGGADLPDHLLRFRRHPAWRRPVRPEGTGQHLHTDHEPHQRCTGTARRGAGRRGRGAGGGLGDGGHHLRDPDRRRSRRQHRLGGQALRRHLQPAGPHPATHRHPGALRRPRRHRRPGSADRRADQGRVLRNHRQPGGQHHRPAGTGRRRSPPRRTADRRQHGSHPGALPAVRARCRHHRALADQVHGRPRHQHRRDRGRLRQIRLGGEQVALPAAEHARSVLPRRHLHRGLRTRRLHRPLPGGTAAQHGGGALAVQRLPHPPRPGDPGAAHGAPLRQRPRRSPLPATTSAGGLGEIRRPRRQPRARPGPALPGGPPGGDPVLRHPGRQRRRRALHRRLEAGGAAGQHRRRQVPGLPPGEHHPPPVERGGTGPRRSLRRHGAAVDRHRAHRRHPRRPRPGPGRRRTLSGSVSPGERFGPCPAWPAG

SEQ ID NO: 32662 - protein, 109 aa, Pseudomonas aeruginosa
ALRKAWMLLGMVEVKGAEEVKPIFSSPSSPRWARRASNTALSTWASTWRDSSRNSRPASVSSTRRLVRSNRRAPISSSSAWICWLNGGWEIPRRSAARPKCSSSATAMK

SEQ ID NO: 32663 - protein, 503 aa, Pseudomonas aeruginosa
RRCLSSTRPLQLGLFTYQSCRSIYWKSYKPIYILCHITSNNDPLSLKSRWRGLVVPARHRPQRCPVSNPQVRPQAEEEPALIEAAREAANEVLEAATEVERYIEKGTPQFMRTSLALFSGGFATFALLYCIQPMMPVLSKAFSISAAESSLALSVATAMLALGLLVTGPISDAIGRKPVMVVSLLAAALFTLGSAVMPTWHGVLLMRALVGLSLSGLAAVAMTYLSEEIHPQHIGLSMGLYIGGNAIGGMSGRLISGVLVDFISWHAALAVLGGLALVAALVFWRVLPESKHFRPAPLKPATLLNGYRLHFRDAGLPWLFLIGFLLMGSFVTLFNYIGYRLLAEPYHMSQAVVGVLSVVYLSGIYSSAWVGSLADKLGRRKVLWAVILLMLGGLLLTLFEPIPLMLAGLLLFTFGFFGAHSVASSWIGRRALRAKGQASSLYLFSYYVGSSLAGTLGGVFWHYYGWNGIGLFIGSLLVVAVLVSLHLARLPALPGNTLAQAAH

SEQ ID NO: 32664 - protein, 451 aa, Pseudomonas aeruginosa
PRACTCPAAASSGICMTPAPAFASCSVRLASARPCDCCGVPRCRCSVSPCTWVTAIQPTSPAPSSAGPASRRATPAPACWAGNQFHEQMPSARQIPRVSLERGKRCPMLLRPASGRPRQRYERDFMKPAIKRACLLGTALFSLCASAAQAAGVLVGTWDLRGNGQLAAVYRDGANLQVVEGGSTRNYSFGNVVWSVFGATDTDGQPGAEILVKAGPDLVIVSHASTTQRKYPVGNVSWAIMRATDVDNVAGDEVILSIGNGVRTVFDRTRTQRDATFSYNGTWGLFDVADVDGAPGKELVLNMGNGVKVIDPRTGGAKDFTFSGYHALAQIADLDGQPGAEIIGRTSTGIYVISNASSRKEYNIGASAWALYGGTADTDGKPGNELIVVMQGKVRVIHHASGASSDYRIGDVNYSIDSVADMDGQPGAEILVRDANGKLFVINDRTGKVSS

SEQ ID NO: 32665 - protein, 180 aa, Pseudomonas aeruginosa
GGYATGATPPANAPEGRRPAHEKGEPRLPFFRSGSAVVLRRQLVHRLEEGAGMGRVDFRGDAVAKIEHMPRTLAVGRQDPRDFGADRRRIGVEHRGIHVALQGYALTDTGPGAADVAGPVQAQRLGADLGHRLQPQAASLGEEDHRHPASVVLADQSIDDLAHVGQGELLVGRRRQAAAP

SEQ ID NO: 32666 - protein, 272 aa, Pseudomonas aeruginosa
VEDLHRLGAGVDLPVEVAGHRLRQLVQQSVHGLRVVVEHRLGLAEVLARAALDHVGGEGPGAAGEADQRYAAVQLAADGAHGIHHIAQVLFRIGNRQRLDVGQRRDHLAEARAFAGLEVQALAHGIGNGQDIGEEDRGVQLRVTVQRLQGHFAGQLRVHAQAHEIAGLGTGGTVFRQVTTGLAHHPDGGDIDGLLEQGAEEAVVLQGSHNGIRSKAAGFTRARAEGGYPQAGGRKGPLLSQSTKQKARRGPCLLSIAVICRSAGGAADQTPR

SEQ ID NO: 32667 - protein, 148 aa, Pseudomonas aeruginosa
SRMPSAAVRPSKIAVTTRSEPRTMSPPAKIFGLLVWCLNCACAGATTRPWLSVAISKRSNHGAGLGRKPKAISTASAGMISSEPGIGSGLRRPRASGSPRRVSTTFTPSTRSSPTMAMGWRLKRNFTPSSLAFFTSLREPGMFSSSRR

SEQ ID NO: 32668 - protein, 843 aa, Pseudomonas aeruginosa
VPIPMNTASYSSSNCSMATSLPISVFRRNSMPMPVNTSRRRLRTCFSSLNSGMPKVSRPPISGLRSNTTGVTPLRTSTSAQPRPAGPAPITATRLPVGLTLDRSGRQPMAKAVSVMYFSTEPMVTAPKPSLRVQAPSQRRSCGQTRPQTSGRVLVWCDSSAAARMLPSETSFSQLGMKLCTGHFHSQYGLPQPRQRWAWSAACCGLNRSWISTNSRLRWRSSFFFGSLRPTSMNWKSLFRRSEFRRSDISKPHHNFGRLLRVGTGAGQQRTEAGRLRFHQPEPTQVVIQVFQDVRAPLACRFVHVLDQDLAQVAAIGLHRLAADPLDFHQLVVHAVDESVVHVEDVGEAPGHAGAEVVAGLAQHADETAGHVFAAVVAGTFHHRMGTGVAHGEALAGGSGGEQLAAGGAVQAGVADDGRFLGLERTALGRGDHQLAAGHALAYVVVGVAFQVQVQATGVPHAEALSRGALETEHHRCLGHALVAVQAGDLAGYPRADGSVAVADVQLVLAAAQAFDGGLRQLDHLLGQQALVERRVFLHLAELRLVGRDQLTAQQRSEIQILLLGGLAGEDLQQVGAADQLAQAAHAEARQPLAGFRGDEGEEVDHHRGGADEVVLAQLVVLRRHAGGAVVQVADAQVLAAQGDHRRGAEAEALGAENGRLDHVQAGLQAAIGLHPDLAAQVVAAQGLVGFRQAQFPGRAGVLDRGDRRGAGTAVVAGDGDQVRIGLGHAGGDGADARLGYQLHRYQRLRVDLLEVEDQLRQVFDGVDVVVRRRRDQGHAGHRIAQAGDQAVDLAARQLAALAGAWGPWATLICRTSALTRYSGVTPKRPVATCLIFELFSVP

SEQ ID NO: 32669 - protein, 689 aa, Pseudomonas aeruginosa
RQRLAGAVELHGRAAARLLGLGRRTTIHGQFGRGGLRRLRLALALHEPGGDHADGHDRKNHQMLLGQVERPSGCLARCATIGQHRFDQGIAGDLVDRSRPAFRLLVDVHQQVVGNQLDALPGALETLGQVVAGFLFAVWLQFDGMEALLTLGKHLQARQQRRLTEQEYMQASLVGAGSQQQQHFQRAVLELFGIVHHQVDVLPGDRQLRHLGQDRLQARLVDAQALRHLAQQRSLVGGGARRDHHAEDRILVGAGHQRLAQQGLAAAQGPGDQQQELAVAGQMVQLAEHRLALRREELETRNARRERVVTELVVAQEGLIGMQAGHGTSFISKLVGQGPIVGAQGRVQDLTGKIAGDHGIPQSLQQNQTQAAIEHFLVDGHVFHKIFRRHLGRRYHGQASPAQQTDTAIALGGAQPTQPMRHLECHHGSRPYRFAVQPDAVTLLGLDRVTEGMAEVQRGTHARLALVGAHHAGLRRARALDGLGDNGRLQCQQGIHVLFQPGDERFVANETVLDHLRQPGGQLAGRQRLQRRGVDDHRLGLVERTDHVLAQRMVDPGLAAHRGVDLGQQGGRHLDEVDPTLVAGRGETGHVTDDAAAQGDQGSLAVMPLLQQGIEDQLQGFPLLVGLAVGQHHRGDLMALQCLEQGFQIERSDRFVADHRDPATDDMWREPAGVAQQVFTDVNGIATLA

SEQ ID NO: 32670 - protein, 679 aa, Pseudomonas aeruginosa
PRCSISATDCDGLIIHDPRCQENQKFVFPVGDGITPEQPPQVRQFAEERHLLHRLALLVTEHAADDDGLAIVDQDLGVDLVLVDRRYAVQHILVIRRVLGHLDFDDDPVVRGDLRGHLEGQRGFLERGAGSAAGTGLLVGDFRALEDLRGFLVRGHDLGLGDDLAVAGLFHRRQLQVEDDVVGDEADADPGGSILGTEVDERRRRLAGSRGGESTVAGDRAAVHAVLVLDPDIAVLAVAVPVALVISAAPAHTEALVVTDVGLDDACLDHHLAHRNIQLRNDPPQFVQSLLGLIGDDAVGAVVDGDRAAPAFLAFLATIAGHRLEQLGDVRGLGVVHLDQFPTQWRQLGDLLLRFQLLALTGGDLVGRGHQQHVAELALVQALGLQHQVQRLVPRHVLQAQGDIALHGIRGHQVQVGEVGDQLQYRTHVDVLEVQRQFLTGIGEIVLLAPLGVFRGHRLDADGQAIVGLVDQIVVEPARFDGDAGTVGLRAGVDKLHRRGEVLDVQANPQRIRQLGLGEVQADLATLLLDIRAQGRVGQVDDHVALALFATLEIDVANGTTRRHVRLGLDRLGIAGRSRASLDRSGGSDAGAGRRIADHHEEVVAFHPGGVGRQRGQVDDQPCAILRLDHRDAARIAHAQLAVLGAELVLYPRQIEGDSRRLLDGIATRRGDGLVELQL

SEQ ID NO: 32671 - protein, 834 aa, Pseudomonas aeruginosa
LFLFPGNPNLPMRLLKFLWWTCVTLICGVLLSFSGAYLYLSPSLPSVEALRNVQLQIPLKVYSEDGKLISEFGEMRRTPIRFADIPQDFIHALLSAEDDNFANHYGVDVKSLMRAAAQLLKSGHIQTGGSTITMQVAKNYFLTNERSFSRKINEILLALQIERQLTKDEILELYVNKIYLGNRAYGIEAAAQVYYGKPIKDLSLAEMAMIAGLPKAPSRYNPLVNPTRSTERRNWILERMLKLGFIDQQRYQAAVEEPINASYHVQTPELNAPYIAEMARAEMVGRYGSEAYTEGYKVITTVRSDLQNAASQSVRDGLIDYDQRHGYRGPETRLPGQTRDAWLKHLGQQRSIGGLEPAIVTQVEKSGIMVMTRDGKEEAVTWDSMKWARPFLSNNSMGPMPRQPADVAQAGDQIRVQRQEDGTLRFVQIPAAQSALISLDPKDGAIRSLVGGFSFEQSNYNRAIQAKRQPGSSFKPFIYSAALDNGFTAASLVNDAPIVFVDEYLDKVWRPKNDTNTFLGPIPLREALYKSRNMVSIRVLQGLGIERAISYITKFGFQRDELPRNFSLALGTATVTPMEIAGAWSVFANGGYKVNPYVIERIESRDGQVLYQANPPRVPVEEQVAAPDAEDAGNPGDPEHPESAEGEGSIEAQQIAAKAQTTFEPTPAERIIDARTAYIMTSMLQDVIKRGTGRRALALKRTDLAGKTGTTNDSKDGWFSGYNSDYVTCVWVGFDQPETLGRREYGGTVALPIWIRYMGFALKDKPMHTMAEPPGIVSLRIDPVTGRSAAPGTPGAYFEMFKNEDTPPSVNELPPGSFPGSPLPDDEGAPIDLF

SEQ ID NO: 32672 - protein, 203 aa, Pseudomonas aeruginosa
TAGRPALPRPRPGTGTRAPGECADPARFGHARPGKPAQRPGRPLRPAAPDPARRWRAPAEVHPPRREEHAARRRPFPSAATGHRRYPGGRPAGPGVPQPPRLRSDPALPRLRLDQPMPALRRADDRAPGQRRVALPPLRPPPAAADELPAMRQARPAPGRRRHRARRGTPADSLPEPSGAAHRPRQHLAQARHARPLRHHQQR

SEQ ID NO: 32673 - protein, 246 aa, Pseudomonas aeruginosa
AMHPGRHPDARQGAPLPTGHPGGDPRCRWRPVFRRLPRQRTHGPADRPGRRPRRTRRGARAGTDPDPPGRSPAAGPAHRGRLLRLCRTGPQRTPRRRPAALRPPRPAARRSAQAGPGGSLPRQRLQCRRAIARADGRTGGGTARAGARAHGAACRQAPRATAAAVHEPSAAASPADALAAEPRTVARRAPGALVARYRSDRPVLSAFQEDAPLDWGQPESAMSGANCRLIAATVGNACPPTDNARF

SEQ ID NO: 32674 - protein, 603 aa, Pseudomonas aeruginosa
PRRFRQQHRHDAGQAGRDEAARPGRQAGRGNPRPRATGQGGDRRPRLPQLLPGSRLARRQPRPRPRRRTSRRAQGRPGAARGDRPVLAEPGQGNARRPPALDHHRRRRRARPRVPRRHGDPAEPCRRLGHPVRHAARLPGRATGRRRGRAARPGGLLPRGEETLRRVSRIRRPRPRTGSQAAGRRPRLPAPVDPLQRDFPVALPEGLRPSRREAEHGRRHGRERLQRRPRPGGRRPDRQGPAHRRQRRVVRLPRRVQERRGQSAPGDRAEGRRRLPLRHHRPRRHALSAQRAARRPRAVLRRPAPGPALPAGLRSGAARRFRSGRHGAGAHGLRHHERRRRPSVQDPRRRYGEADRPAGRGREPRLCAGQGTQRAARRAWRGAVRRGPAARDRPGGGDRLGEVRRPVQAPHQRLQLQLRTDAELRRQHRTLPALRLHPRGQRLPQARPGPRATGREDRPRAAPGAGPGRTAGAVRRPDQQRRAQGRAAPALRLPIRVGRAVLQLLRALPDPHRRGPGAEGQPPASRRADRPYPGTGPGAARSEDSGTHVIEPARTGVREPPWQRRNPPPSAAPAATRRPPRRTAFPAGSGWSPAWPSAASSCS

SEQ ID NO: 32675 - protein, 138 aa, Pseudomonas aeruginosa
SSNPGARTSSANARTPSARPPPCRASSRSRTARPSSPRKRRRRPRPSRSTSSTPCCRSPRSWCRRKRYRRRPRRRPPPPNWPRPTKRGPRPHSPGRCHRRCRKRWSPPARSSSCRPARSASSPTPTACARRSSCSGSR

SEQ ID NO: 32676 - protein, 251 aa, Pseudomonas aeruginosa
WSARSTAATSCPRRRRHCPPTASATCCYSNARPAERGPRRAFRRTAVRAVEKPRIAPISPSIPGIRPRSVEISPLTTIVSVRRNGKVVMGGDGQVSLGNTVMKGNAKKVRRLYHGQVLAGFAGATADAFTLFERFEQQLEKHQGHLVRAAVELAKDWRTDRSLSRLEAMLAVANKDASLIITGNGDVVEPEHGLIAMGSGGGFAQAAALALLQHNAELSAREVAETALNIAGSICVFTNQNLTIEELDSAV

SEQ ID NO: 32677 - protein, 418 aa, Pseudomonas aeruginosa
TNVHDAPRDRPRTQPPHHRPGRRQARRRHRPAQPLATHATAGRAARRGNTKEHPHDRPHRRRQDRDRPPPGAPGERAVHQGRGDQVHRGRLCRTRRRVDHPRSRRRRGEDAPRTGDPEGQVSRRGRRRRAHPRCPAAGRASRHGLRRRAGTRGQQHPPAVPQAPARRPAGRQGNRHRGGRQPGRRGDHGPARHGGDDQPVAEPVLRHEQGQEEDPQAEGRRGPEADPRRRGGAPGQRGRAQGTRPGGGRAARHRLHRRDRQDRQARQRRRRRRLPRGRTARPAAADRGLHGEHQAGHGQDRPHPVHRLRRLPPEQAERPGSRAAGPPADPRGAQGPQSERFRAHPHRAACLAHRAVPRVAEDRGAGHRVRRGRHQAPCRDRLAGQREDREHRCPPPAYAARAAAGRGLVQRRRPGQRA

SEQ ID NO: 32678 - protein, 582 aa, Pseudomonas aeruginosa
PAGHLVPGFVAVPCFASNNGALPMSQKNNNELPKQAAENTLNLNPVIGIRGKDLLTSARMVLLQAVRQPLHSARHVAHFSLELKNVLLGQSELRPGDDDRRFSDPAWSQNPLYKRYMQTYLAWRKELHSWISHSDLSPQDISRGQFVINLLTEAMSPTNSLSNPAAVKRFFETGGKSLLDGLGHLAKDLVNNGGMPSQVDMDAFEVGKNLATTEGAVVFRNDVLELIQYRPITESVHERPLLVVPPQINKFYVFDLSPDKSLARFCLRNGVQTFIVSWRNPTKSQREWGLTTYIEALKEAIEVVLSITGSKDLNLLGACSGGITTATLVGHYVASGEKKVNAFTQLVSVLDFELNTQVALFADEKTLEAAKRRSYQSGVLEGKDMAKVFAWMRPNDLIWNYWVNNYLLGNQPPAFDILYWNNDTTRLPAALHGEFVELFKSNPLNRPGALEVSGTPIDLKQVTCDFYCVAGLNDHITPWESCYKSARLLGGKCEFILSNSGHIQSILNPPGNPKARFMTNPELPAEPKAWLEQAGKHADSWWLHWQQWLAERSGKTRKAPASLGNKTYPAGEAAPGTYVHER

SEQ ID NO: 32679 - protein, 283 aa, Pseudomonas aeruginosa
AAIHAPGTTTPSAKRAAGGRSGWAGCRSARASWATLTSTLAAPRIRPSKRPRAPTCIYAERSGPGAWSRAPPSPEEVRMKTRDRILECSLLLFNEQGEPNVSTLEIANELGISPGNLYYHFHGKEPLVMALFERFQAELAPLLDPPEEVRLGAEDYWLFLHLIVERLAHYRFLFQDLSNLTGRLPRLARGIRTWLGALKRTLATLLARLKADRQLRSDAPALGQLVEQITLTLLFSLDYQRVLGSKGEVRTVVYQIMMLVAPHLRSEAQRSAESLAQRYLGPE

SEQ ID NO: 32680 - protein, 97 aa, Pseudomonas aeruginosa
VSRSAWSAYRPCCAAPSPRCGSARRDARWRCSGACRKLPRARSTCRAHGPEPRRPCSSQSGRKPSPHRPARPHRTSLLFQPSRRLSPRSRTACCRPC

SEQ ID NO: 32681 - protein, 675 aa, Pseudomonas aeruginosa
GGGRLHPACAGRQPPAPGPGARQDPRPAQPGSQHGRRQRGPAGTGRHPAEPGAGLGVRTVALARPARHPGARQRPARRFALERAEPAQPAPEPGRLPCRGKPYAGRPARSRSTLRRTGPAEAGPRSSRRARRTPQPKDQARRMKLLAVRRLLRIQRVVIRYRLDDLILELPMLPWWLRLLGATLPWRWLPRRKLELTRGARLRLALQDLGPIFIKFGQILSTRRDLLPDDIANELAWLQDKVPPFPPELAVKRIEEQLGAKIEQVFARFEREPLASASVAQVHAARLKSGEEVVVKVIRPNLEPVIRSDIAWLFILARLAERVSSEARRLHPVEVVSDYEKTIVDELDLLREAANASQLRRNFEGSPLLYVPQVYWDWCRPKVLVMERIYGIPVTDLETLRDQRTDFKALAERGVEIFFTQVFRDSFFHADMHPGNIFVSTRAPWSPQYIAVDCGIVGSLTDEDQDYLARNLIAFFKRDYRKVAQLHIDSGWVPAETKVNDFEAAIRTVCEPIFEKPLKDISFGQVLLRLFQTARRFNMEIQPQLVLLQKTLLNIEGLGRQLYPELDLWATAQPFLERWMRERVSPKQLLRNFQQQVEQVPHLSQMARDTLERLSQPHAHNAPPPEWKGSRHDWLGRLVGAVLLVGAAEVGLGQQLEAWPAWVMLAGGVFLILRR

SEQ ID NO: 32682 - protein, 497 aa, Pseudomonas aeruginosa
TRAARARPGNAPGLAPDRTAYAPAAQRGGDLPDLRRPVLLLAEDLHPGLRAVAPLPSGRHQHDRHRRRLAVPRAVQADHGGGAVPRHAGDPRAGLGLHRARPVQARETRGAAAAGVQHHPVLRRDGLRLLPGVPDDLPLLRQRDARGRGDDDGHQQLPGLRPDSVLRLRRRLRDPGGHGAADLDRSGRRRVPEVDPPVRDHRLFRGRHGPDPAGHLLPDHARGADVAAVRDRPAVRPPGTQARRASGRPTGQRRRPASGHPPVNLLLLDDADFVSADRAVLHDRRLKHLHEVHRAENGDTLRVGRLGGWMGEGRLLKLDASEATLEVRFDQPPPAKLPITLLLALPRPKMLRRVLQTIAAMGVPKLVLLNSYRVEKSFWQTPFLDPAAIRENLVLGLEQARDTVLPEIIVEKRFKPFVEDRLPALAAGSLGLVGHPGPWPACPRAVEKPVTLAIGPEGGWIPYEVDKLREAGLHPVQLGERILRVETAVSALLARLF

SEQ ID NO: 32683 - protein, 214 aa, Pseudomonas aeruginosa
DLARRPRTGPPRPHAGRDDAEPLPVPPRHGAANPGCRTAWSNDDVRLVGSPTGQAERQPQADGRFRCPPRAASAGGDQQQPHPHAPDRPQRAARRSRQPDGTDPASRTRPPGIRSRQRPAPGRAGPPDPGRDAPAPAGAARQRARPGRPGPPDRSHRSLPQGFRRPRRSRSATQRRPWCAGGHCTAGAGQLRPPRGTDGRQPRAAGRRPAGVAT

SEQ ID NO: 32684 - protein, 221 aa, Pseudomonas aeruginosa
PPGLSWRDRAVPCRRHPHAPGAASDAKQHPGYGPGRPDPHRSRSPIAREHRQPRPRQPLADRRAGPGLRLRRRLGDQPADRPAAGRSPRAGRGHRRRRPRQASAESPDPPAPRRTGPIAASHAAHGRQPARAGRADRRRRQPVGQLRRGTLGGHRADPRRGQQPESGDRPGRHRHARDGRHRAGRRAQRRTGFPGRSPGRRRGAPGRRGGRPGGDPHRAPG

SEQ ID NO: 32685 - protein, 215 aa, Pseudomonas aeruginosa
RNGRFQRSHGAPEERERADRQRPRRDQVGGRANQPAGAQRSHRSGTRRRRRTRLRGGRRRGPRPGPAHPAVHRRDRGPDPASPAGRRRSRRTPGEQPLADRQHGGTGAPRGRRAGQHHPHRLRHPEHEPADRHCRGATEHGGRGDQPQRPQRTRRRRAVGRRQRADRRLQRRAGAPGHAVAGTGGTLPPVTSREDPPCIGSPSRPSKADRRGTFA

SEQ ID NO: 32686 - protein, 336 aa, Pseudomonas aeruginosa
WSTRNCCRTGTATRTSACANGRWTGWRTTISSRPRGRVRRRSCRRRASRSPSAVLEDLAEEGLGPRVLRIVEELRRRRVLQQLAVVEEQHAVGHFAGKAHLVGHADHGHAFHGQGLHDVEDFADHLRIERRGRFVEQHHLGVHAQRASDRHALLLAAGQARGIFVGLLPDADLGQQRPRLGLALGLAALAHHALGQAEVLEHGHVREQVEMLEHHADFAAVGIDVGPRVGQVDAVDAHRAFVELLQAVQAAQEGRLAGTGRTDHHQYLAPGHAGTHVVHRAHYLAAGIEDLQQVAYFNHFVRASAPVGMPCAKGAGSTAGTTRRRRTRSRRWRTRW

SEQ ID NO: 32687 - protein, 345 aa, Pseudomonas aeruginosa
PRPGRSRWPVTAPRPGRRSTAERGSSAIHRKSARWRTTAPRPGPAGSARSAGARARRNVSSWSRKLSRTMECAGTTAPFAGAVSGSFHFLQPLGVLEPLVVDALIGAVFADLMEEVVDEIDAVVVAFLQAERQRLVGERLVEVDQLAGAELAHRHHVVGRVVDEGVGLAVDHVHHRFRLVVEAVVLGLADQLAGNDLTGGADLRGDAVLRIVQVLVGLDLAFQFLAHQQGLADHDEGLGEVQAQVALLGQGHARADHVELVGQQRRDDAIVAGGDQLQLDAHGLGHGLEQVDFEADDLATLVGHLERHVGRVHADPQGAALDRVLHRAGRLDRSHAHQGADAQNQ

SEQ ID NO: 32688 - protein, 280 aa, Pseudomonas aeruginosa
SKILFHSPIPSSLRNTVVERMLSSCRRPGRAAGHDRLRKRRPIVPQLANDTRLSGLPAQGNSSAARGKQARNRPCPRRRSAGGMGSGLGGGQQAGVAGHYLGQRYAGGVGVVRLGLAPAAEPVVAVLFPDPRMQARKCYRVTQQSQARGAVELFRALIDGLADTLAAHRLDGLRTVVASRAHGAGQGVEQRIDGGLEEAILERMPAVLVGVLVGGAQLARRVVLLRDQEQLFVAGAQAQLHPAGDHRYRDRQDQRTDDRRQPPQEARVEPGHQQGPGDTQ

SEQ ID NO: 32689 - protein, 697 aa, Pseudomonas aeruginosa
SLHAVPADRLAPGRGVVVALRRVPLHRPAEEGGKHEAGVEEHAHRRQQHREEHLQEHAQGHPDHPAETLGALGPDQHYAEQLGQEQQGQGGGEQRDGLLRMPLRPDREQLPRFQEVLRLHQLVHRQQRGGKHQEEEPQRRRQVGHDPGEEHRAVHRVHALDQEQAEVHQVAVAPAAVALEFVEQVRRQFFVAAVEVVGDPHAPAGTAHQRSLDEVVGQDRAGERALARQRRQGAVVDEGLHADDRVVAPVVRLAELPEVQAGGEQRAVDAGGELLHARIQGVHAGRLRRGLDDPRLRIGLHQAYQLGQAVAAHHAVGVHHHHVAVVAAPAPAEVVDVAALALHPTPAATVEDLAEALGLAAQLEPGLLLGDGDIRVVGVAEDEEVEALHLAGGGHRLDGRPQAGEYPRHVFVADRHDDRRAGVGGDRLAAGAAAGDPVAVTPGEQLPEAHQRGPEAGRDPTEEDREERQDAELDDIGQHLLDGIQQALLGQLLQVDEGPALVGQDAFHVVGGDRGLRQHQQQQDEPAQRADPLPAGPRQGTLGLGRVAASGQPTPAAHQDVGAPGLGNHLGTADRRGNLEEGATLGVDAEHLGVVQLRGAQLQAGAYRGQGGIAPGIGSGAFRSRQASVQLGEGSGLAKPLPLLFRQGKMSEVVGQRCFRSGWVIHRQAADSSRFRSVASAPRRPAPRAFPPVSSDP

SEQ ID NO: 32690 - protein, 370 aa, Pseudomonas aeruginosa
AACAASSPRNARHPRARPRPAPAGRDRWSRRFRRQPPPAPRRRAAAMPSFGLRRQVEQSPADLVGGAHQRIDYPRLAGGMPGVADDLQFAVRPGLVQGPGIVQRTDGVVAAMHDHARQMGDAVHVLEQLVGPEEALVDEEVVLDARDRQRPARLGEAVHHHGVGAQRGGAALPGRPGLGGVHLGDLVATGQALVEGRQQVAALFRRDRRDIVFPIVGEQAAGAFLVEPVDVLRTAKEDAAQDQRMDPLGMGLRVGQRQGRAPGTAEQHPLLDTQVLAQALHVRHQLPGAVLLQAGVGRGTAATALVEGDDTVEVGIEEATRQGIATGAGAAVDEDDRQSVRRTAFVGIQHMRFVDGQLVASVGFNFRIQN

SEQ ID NO: 32691 - protein, 223 aa, Pseudomonas aeruginosa
MVALRIRSLRDPASASSASIFASTSRVWPWISSAWPGTWPERNTRASKQTAADRRSLVAIRVGSMGVLQVEGNSASQRAARKQARGIDARRAAADLLGQQAPAAAGQGEAERAVAEVEPEVAVAAVAHQRYPGGRGRAHAGPFDGGVKIAALRERVSRLLAQQCQARGLEAGVEADDVDHRGDPQPLADSRVDDLAVVIGDAGIRRAVLRADRQGQAIALERV

SEQ ID NO: 32692 - protein, 295 aa, Pseudomonas aeruginosa
PAGGAAPGAEPAAPTGPQPAHRRHPGPGAVAAAAGDRRMERALSAERLRTGHLAFARAGAGPADARTGPGPKPEAAGTPRPARRSHRQRRIGGPGAARTLARSGTPAAAEPGRAGRRSADRAVHRRPAVRPPGGLPQRRGATAAGEDRRADLRPRPRPGGGWGRPGAGRSLHRPRRRPAQHRNPPIEPGLPGHPLRHHPRRRNPAAHPRSAAADARPPGRGAFAGRADVAFAAWPAAGNLGRRSGPRLAYLPLRLPVWAVHVVALGRVRRQRMVLYQIGKTQIRISGKLIVNTII

SEQ ID NO: 32693 - protein, 316 aa, Pseudomonas aeruginosa
GQLHACLDHYLVAGLEMDLVARLDELAGADPQVQRVGDAEVVGRLQFDLAVGMDRALFLGPELAVAIALDRVVALVADADLLVVLDVLVPVALGVDEDLFLALAVLDAQFVETAAAGVAVGLENAAGLVLRQLVGHPVFAVVEAAGDQRLIRIALQETHQDFHAHPRDGDAAIAFARPVGGDAQPATGVVVGLAEAIPEELHLDPAVLVAVDGLAGGAGHDRCLAAQQAWPGMLQRGPEMRAPGSGDETVAIALAEIAPALRDVAVDRLFQYLRLPPFVENLGKQPEIVPFAAGMRGQRQEVSAEQRRFVAFAPGL

SEQ ID NO: 32694 - protein, 627 aa, Pseudomonas aeruginosa
VVGAMPFQRAPAQVLAALAVGEAAGIVVVLQVRLLRPGLRAMGGLHLQRGLLEVVVAPGNPAGTGVEAHAEALDHRLVGDQPGVLHVGDGALQPRKGGLVVAEDQHMALGRKLMVVMDAFLLAEPAEERQVGFVVLRAVFAGRVRRRAQLEAVGVGENAVALQHPADDFRHAEALEDALVAAQPQVGQARLQGRAIAGQALAGVPLGDAGELSVDPLPARREDQEGRLVQQRVEVQIGSLADQLQVEAKGLADGFATAEGEYLEVVPEVFDAKAEVRLVGGGEHSLSSWKRSRAFLAYSVPGATRLSPRDGNAGREDRGEQLCNSLRTRPPGRINADLNKFATENFQNADADAPPHPRPSRPPGRARRPPPPSTSGVALATPGEEAFQQFADDCAGRFGEVRAVSERGLLVHVGALRQLQLDGMDVLLRLAVVAGDVAALEAPVEHMAVAFGGSADRLQAGRQRWIATGAGVGAEIEVGQSAVEQVRHVGTDRVGVPEQRVAELGLQPRQFLGDGPVVGRPHFSQVAHAFLGGRRHAFAVERPAVEQGVRIQAGSGGAVQRLVVGRAVEIDHIARIVGSQGAGAQFLGEIVEPGNVPVGIGQRPRLLHQAGVHRRGQARAGVRHADQ

SEQ ID NO: 32695 - protein, 518 aa, Pseudomonas aeruginosa
GWRHGNAARVVSLQVSYARGQPGETLPLAEDGRRAGDVGSQPAVGVVRGHALAQDAPGRRGALAEALRGEEFEGLGGQQVLDGEDPPEVLQGPAKLERGTGAEAQVVLLERRGDEVVDHRRLRQLAVLASQGGGDVLGDHHPRVDSRLAHQERRQAADQRVDQAIQAPLGDPAQLGHGDRQQVGGHRHRFAVGIGLGYHPVGFRRTQQQRVVGGRVEFGLYLPRRVGQLVTAGAMDLRYRADAQGILGADAAGVLQYLAASQQGSQIDGDPLHPGMRLERNDLGVERRQLAAQGLEAHRPDHVGPLRQALRVVQGQAGEAGHARRAVDQAEPVLGSQAHRRQAFRRQRGGGRHDAAAVADLADAEQGDADVRHVGQVAHRALGRHLRGNAVVEQRQQSFHQRTVEPGLALAVVGDGGTDDRPGLFVAQRLADPAGMAEQGVARQLGELLAFQQDVAQRAEAGTDAVGTLAVGDDTADDGAGVVDPCPGRRRQFQARTVPGHRDQFLPTQRTVAEHDAR

SEQ ID NO: 32696 - protein, 279 aa, Pseudomonas aeruginosa
CRRSRCRRRRIPPATGRRPARAQPLGRNPPCCQRLCTPVAGVAAAAQAEAEEQDAEPGENHREDGTDLDQRQPELQLAEDLDMTEVQPADEQHDGQYPDPARHVGKPEPHVDAERGDIGEADDDHLESVGPAGDEPGQGAEIAAGVMAERAGHRLVHCHLAERAHHHVHRRAGDQVGQQHRRPGHLDGRCGTVEQAGADRRPQCHETNMTGVQSAPKPRVVRHPSALLLLFLLERPGRAAGGGYQRLGNSRAGSSAFRQPLASNWLAASISGAKKRSSW

SEQ ID NO: 32697 - protein, 764 aa, Pseudomonas aeruginosa
YGTLSRSRRRACSSFGELFRPSRKSRPWQAPSHSTARIPRDVLGHRPEPFAGVRRHRHMVFLVGRGRQAVDAGRMGQGLVVAGQRGGGDLGDHEAGVDPAVGHQERRQLRHVHVHHQRDAPFRQRTDLGQRQGQVVGGHRHRFGVEVAAGDHVALGGEYQRVVGHRVGFDLQHLGGLAHLGQAGAHHLRLATQRIGVLDLVALLMGARHLAAGGEQVAIGRGHVDLPTLAARGMDARIERRPRTEHGLDAEPAADGGGGEQVLGLEQPAQRVGGGHLGAIEQGQAFLRRQGQRLQPGHRQRFGGRQPLTAMARPAFADQHQRHVRQRRQVAGRTHRAFQRDVRIDLGVDQRDQRVDHLAADAGEPARQAVHLEQHDQPHHGVVQRLADAGGMGQDDGTLELLQVGRGNPRRGQQAEAGVDAVGGAALGDDVLDTGDAGGDQRVGAGIQAQAHGGQVCLAQVGQGQLAGFQMQAHRRLLVRFGGLGSAVRRRRFMGLKAAAPPWKFVSGPVRGTFEGAGIGRQDHSRRGLARGLAPRHQVVEDRRHQQADDPGDIHAAEVLDHRSGVQRGRQERHLHQHAEGIDGDSRQVPATVAAVGVGQRGHVIALAGDEVVVDQVHRAPRGEEGQQEQDEGLERSEERVLAEQRDERRGADDREDEEQALHAGDLQLAAYAADDGRDAHEAAVGVQRGNGHLAEGDAEVEQRGDGPAAAQADDVGHLAAGELAVGQGCGEHPEDHRGLGAEHRAEADGEEGLPRRGGRRQVA

SEQ ID NO: 32698 - protein, 280 aa, Pseudomonas aeruginosa
IVGHVGAEGDLPGRRQRHREEERGPAEMADGEQVADVAEQHQAAEQVGEGDDAEDAGDPPDDVDDAIAEHRHQDDEGGEDEDPGAVAEPGELADGLAGKHRAGGGEAQVHQAHQCDRDAGAVDAELHPAGNHLRQPQARPLRGVQGHHRAAEELADEQADQRPEHVAAEDHGEGAGDDGGDLQVGPQPEGELAVEAAVALVRRDVVDRAPFDQWLAVAALGHAAVLRCGSRAAILVVAWSGQWAAAPTPRRRGGGFRGQRWAVIIGRFRPCSFAQSMATW

SEQ ID NO: 32699 - protein, 163 aa, Pseudomonas aeruginosa
PASACRITPVPGSLVSTRAMRSAASSLPSQTITIPECWEKPMPTPPPWCSETQVAPLAVFSRAFSSGQSDTASEPSCMASVSRLGLATEPESRWSRPMTIGADSSPLRTISLKARPSLARSPRPTQQMRAGRPWKLMRSRAMSSQRCRWASSGISCLTLASVL

SEQ ID NO: 32700 - protein, 292 aa, Pseudomonas aeruginosa
HRSAQLRVTPALRLTLVVEENPVMLLAGREEAFQRQCRGQVRALDQRQVQRFEQLAALRRTPVQRGDQRQGRARRAAPEHAQAGQALRCVALQVAEGHCIHRGQLDLTRGHHRQAAQVAAADVHLGEERRVSPQRRQRMAQQVHAAVGVVVVERQAGIAEVAEALARLSFGGDEQAAMLAGSTIGQVVAGHREHRHLAAQLGHQRIAAGLREQQVRLSPLHRQIGGGRRVTAHAQAPADLADEDCAGLPDAVRLDIHVQRRHHRGIDHALVRLPSMLGMHRRIHRPPTVAPP

SEQ ID NO: 32701 - protein, 294 aa, Pseudomonas aeruginosa
TTIAGQVEIATASPVGTAACAIHARQQVPGQARQIVVDQMQVVVEEQQPPRPPRLDQHAALRRLVGRTVLVERAQHAQAEGRIGHRRQVQPGRDARPAPKPGQQPAQQHGMQAPQAPGGALSPAQPRTLQARHRRQGQQRAEGGATKQGLVQAEPAPPPGAQARPLGQTDVATLGVQPRVGQLLVEVVPQVAVTVQRIGIPDGQWQVAEHGVEPRPAGRVAMDQLMLQRHVEGGERHQSRQYRPTPALILAGEQCPTAVQAGRSAARSAIRCAPGRYPGAAAPGCADARSGSAP

SEQ ID NO: 32702 - protein, 265 aa, Pseudomonas aeruginosa
AETSFQTVAGTRVQQPRGGHRDTPGPCAAADQQARLAAFDLQQLALGRLGEDRLDHMLALGERRHLGQVGIGRLPGEILLEVVRRHRGVHVAVLDLHRDIVLVVHDQRVEHPLAFAHVQCQGALGAGDLLAEGDHLATMAMPAGRDLVGDVVHLEQRRLALGLGDEGSYPLHAHQQAVAGQFAQGAIDGHATEAELADQFALGRHPVVRRPGARLDLADDHLLDPRVERRRYLAELRGQRGTIGGRGRHGETPCRGVDEVSLRTA

SEQ ID NO: 32703 - protein, 276 aa, Pseudomonas aeruginosa
TCVAAGRLGAKCPFRDFRGRSPRRDSSRRQRRRRRTPRRRRAAGDAQPPFARVPARHGRARRSRRQSQRQFLDLARADVPDGRSTVAGTDRGHRLPALHRDAQGRLHRGGGIPLRPSRPRRPPLRRPRRTFPAHLPRRQRRRYRPDPAARALQSRRLRRPAGQRGPAALHQWQRGLPGTAPAPARAAGGGRPLPGPVLPLPARGDSAADRHGPRRRPRRPAGPHPYRRTAEGSRRLPGLERTPAVAMAVRERRGRPALVPGPCDPRRPRRGGGDGA

SEQ ID NO: 32704 - protein, 143 aa, Pseudomonas aeruginosa
SRRGPSRRPAGARRQRPLPGQRRGRRPAQPLAVRRRRPPGARRDGGRQMGGARRPACRGRAQRTGIRPGAGGTARLTLHSGGQPRCAYPPHSFEPSGAKRRYFPRQPPGVNGAGKKKRPGGAFLHWLRFNWPSGTRQISSSTA

SEQ ID NO: 32705 - protein, 198 aa, Pseudomonas aeruginosa
GTPSPPRWRGGREWRCDGESDRSGRLPHDAARHSRRNRRRACARCHRPDRAGRGSRLPPAPGWAGPRRAPGPGRRTPGAPAATGGRSLFPGPRAPPVAPGRRRRRRAACRGRSSAATGRATGSAPASHRPRPSTPASRRPAPGSPGRRNGRRHRRPGRRSCRTTGRCAGQPPRRRRWRCRTTSRARSPRARSSAYSAW

SEQ ID NO: 32706 - protein, 676 aa, Pseudomonas aeruginosa
CRRAPFVPSARNATGAARAPVAATSEVQAQRQADALLGIVLALAPVVAAAQRQLRCQLLAEAEGDAVEVVLRGVAFEGKAIARQAVEGHGEVLGVVLVLAFVGVLGEQLSIAAERVLALQAGAQALRAALLVVVVERGGAGALLGIAVDLDPCIVGADERRQVPGTVGLLGDVVAQARAERPQVAVGVAFLAALAAAQGELALQVVVVEVAAGQRRVGPPAGFLVLHEGAGHVAVHSVVGILGAGFQLLPVETGGDPGAPGLVDAVAAAKGQVVAIAVAAGGAVLGVEVQALAAAADEAAPLADVLPVLPVRLPLAAQFVLVGTQGAVGHFRQQGQLPGRRQQRIGVVGDQALAGDGRVHAVVEQQFARVGRAAVDPVGRVHGTAVAAETGADQVLVGGQAEGSRVGHAFLEQQRDVQRNDVGAGLAQLGGQLGVERAAELAGERLQGTTEGSRGQAQVGQQPDHDVARAGLLQGLHAIHQATGGLLCLEVVEDAPLEEVVAAAGDVVQRVRIGTQALAGTVHQVAIAAAQEGIVALDQRAVGRGDRVVDLVGPVAAHRPVVAVGRCPAGPLTGEVEAPRSPGGDAELIAEPQGRGRSEDLAAAVLVGRADPVGETRGASGGAGRIGELPGIAEAVAEHHQRRIRRRSSLRGGGQRSQQAGRYQWLERHSDHSLTP

SEQ ID NO: 32707 - protein, 487 aa, Pseudomonas aeruginosa
RGTGSWLVRRGTQQAHCHYYQQSDPQQKYRPQADLLPVATRCRRRDRHGHLQRFAQAGATQGGALALGIAGNQYAERQRRRLRARLAERQPVRRAATHQEHQFAGRQADTQGRDLRAQAGTSLVHLQTQLAHRPARQFQLVLLYVAAVDRQPVENPACQAAPGGLPARRSVLRTITAGQFHRDDGVGQRLLQGHPHPLQRQRQRQLPAVLAVPRLAPGQRLGPDHRRRLGAPRAALQAGALEVCRGCPSRPGQTQVAGLAAGKLDLADVDAFAVEGQAGDLSVPPGLPMLEVVAGFHGEALEALLRAAPVQPQALQGKRHRARVDQPAAQSLGSRPGVFRQHLDYGAAGVALHPQVRLRRVGGGRASQREQPHLGLMRRAGLALAAGHQGVGQGLAFGIEDPQVAQVGMGSRQLHAHRDAQAIPGTFALQRQRHLAAETFGRLLRRQRQGQAGAQQEQAGGSERKGARHGCSASDATSARRGGKGEK

SEQ ID NO: 32708 - protein, 751 aa, Pseudomonas aeruginosa
KLRRWRSTRLSQMISSPLPAHTALALRQGRTNSTARLTNARPASSTRLKPMSSRLSSFTSGSRAASSMPPISARPISEAVIKPRQPESNTPPWPSPPCKCRRNSAPPSSCTAKAQNRKVREPRRKPANKLARPGHGPGDGGAVDGQAERCDQVEEGQAGGRQQRPAGRLPVGQRFRRRATQLPEAEQRRCTEHQRAQRRTLQQRRLTRAHAIQVGQRRTALQQQGEEPRQAALLVQAEPVDAGALDGPGGRGPARVQAERNGQGAEDHPQRQADFHQQAGASGRSMAAQHPRQDHVEEPQGQGAEGHAEVDVADHRALQAEPHQWRAEQHGGVDVVGLSRRPAQQFAALGRRLRGLQQLAAGEEQADPDVHQEEQGQERLGAGEQLRCIGAQSPGEADAEGADEADQVERPPGAEPGDGEDAGVEQGEVAEQRYMVAAAGGGQDRRGEAAERRHHRQAHGVLQHGEDRRADHHHHQQGQRRAGRDQRMQAHGGEDGQVQHRDTGALQDQAVGGAPLAQPPADAEQRHRCQRHPGVAVLHRHRHPFRGIAQEEGQADEQQHHADAQYRVAAEQPALGRGEATLDQRGFAWRRWRGGTARRWLGVRLERRLTLDGLDGLGGTRRRRRSLDGRQLDVPVQRRGNLGGRSGRRVCERLVDTGGRLGNAFGKVLRLALHAQQALVDDLGAALEAFGEFAHLLAQALVLLRQVLQRDGLSQGQAGKAAEEGADQRFPGEAAEDQAHQHENPLHASNP

SEQ ID NO: 32709 - protein, 148 aa, Pseudomonas aeruginosa
VLRSRQDVRRLLHRRLERHRSLRHDPDAGRQHRRPRSVHRRADPDPGLRHHRAEHHARLRARPAQHRQARRGVPEVHRHRRHRVRRPGAGVLHLRRSEVQVRHLRLDVQDLLRAGFLEHRRRHRVRQQGPSPGREGRLLPGTAGRPRP

SEQ ID NO: 32710 - protein, 315 aa, Pseudomonas aeruginosa
NPHRHVQRPGRNGPGGRSPPPRSGNRRPERDRREVQHPGRQGRRSADPEVLRAQRRRRLRQDRDLHAEAAVRRQRFGHARAHVDLQGRQEHLRRRRLCRPVRDRPVLHRRHHQARQGPERLHQPLDQLLQAPGPGLRSSGDAGLLGAQPFRLDPYPLRIQPEGPPYRSALPGPGSQPLPGLRRAADGRPGRHPEQDPPRRCRRQEPVRPAAGRGEGNPAGLRQPERGAGRARQGPRVPDQGRRVHRRVHRCLHRAEERRRDQGAHLRAPRWNTTCTTASDPPFPITTSHPLEASFGRPFLWAGPWRNAKFAAPFG

SEQ ID NO: 32711 - protein, 173 aa, Pseudomonas aeruginosa
TCRAPRPKDKDRPCVTLSGSCLPPSSACPPRPAPNAAISTTATCGACATHWNAATAGIAATSTAATCGVTAAHCWRRDSATTATTSATATRAASAAPSSAATASAATTSTAATCAASAGPWYRVRRGSATASTTATCAASAGSSCRARCRRPPACPARPVPRISPWAPGSTVR

SEQ ID NO: 32712 - protein, 377 aa, Pseudomonas aeruginosa
QLLFVGTEIGGDHLLVMADLFGVATGDHVAVVEHDDVVGDVHHHAHVMLDQQYGDPVVVAQVADDVAQGVGLGRVEAGGRFVQADEFRPRAHGPGDLQAPLLAVGHLAGQAVGAVHQVDHLQPVERVVQRLALGAAIAGSVEDAGEQVAVDEHVLRHQQVLHHRHVLEQADVLEGPRQPGAVHQVGAAEHLVVEATAQLRRLDEVVQLERLAEHLDDVRGAPLGVEQDVAAGGLVEAGETVEHGGLAGAVGADQRGDRTALDVEVDVVERLDAAEVHHQVLDAEDLVAHGATPLRGAKPTRLMRISPRARQIIITTMSIPSSSTRMSAKLRSSSGATVRTKAAFTTPTVEPMPPSTTMARISADSKKLNEDGLTKPW

SEQ ID NO: 32713 - protein, 365 aa, Pseudomonas aeruginosa
PSRTTPTMGPNTTRAINPESTASRTHCLRSMEVSLLIVVPLHLGDLRAAEQALGTEDQDQYQQREGEHVLVVGVDHPRELRLGHSQHQAAEHRPGQRADAAEHRRGERLDADDEAGVEVEGAVVHGDQHPGQGGHRCADDEHVGDHPVGVDPQDRSHLAVLLGRPAHAPELGVADHVGQHRHADQRSDQDEQLGVGELDETVADVEFQGAVEQGRDPLLARSLRHLHVVLQDQRHADRRDQRRQARGVAQRLVGDALDHPAVGAGHQHGEQQGAEDQQREVLQAEEGQQGKGDGRQVGGDHVHLAVGEVDHADDAVDHGVADGDEAVDRAEGQPVDHLLEEDAVHFSVSSGRIATAFVRRAGARR

SEQ ID NO: 32714 - protein, 416 aa, Pseudomonas aeruginosa
KRTGATETAPDRGTPDRPHADVFGESALRRQARASTSAAPGLTHAPGLCPAHGGRARSGQLVVLALVVPLVDHVVGDFQVALLVPFLLAHHGLHRMRLQPLGGLGRIVGAGAVEGRRQGLDRGVGVEGVAFRLETAGTEFLHHRLAVGDQPRVGAEGHQHALDVLRTAGGGRQFVGDHAVVGHELGGQSLFAHLPYQRTGFRMQAAEVDDLGTGGADLGDQRVEVLLAASQALVENLFHAELVQLRPGGVRQALAVGVLVMDHRDLLGLEHVDDIVAGDHALLVVAAAHAEHPGESALGDLRVGGTGGDGDDPGLVVDLGCGDGRRRAEMADHGDGLVLVHQAVGHGHGLLRFAGVVGLDQLDLLAVDPTRRVDVFRRLGRAAPVLLAEGGVGAGMRSGHADHDVGQRMRGKTHHG

SEQ ID NO: 32715 - protein, 906 aa, Pseudomonas aeruginosa
ASPGTPASELSSLRHSVYSYNAFRPLHPRQETRHAEQTPPAVDDRPAMLRSGSPAPELHPRRRRVEPDPERHEQAGRATRGATAARPVPPGAQALATDPGRRAVPGRGTTHPATGRAVHPLPAFLRRRDRSAASGDPADLRRALADPATERLAPPPPEHPPRPAPGTGTGRPAPGPLRPGVLLRPRHPAGRRVHPPVRRTTGGGLRAIPVAGRRTGRTDPTGGAGAAAERQPRGGLARLVRQPGAKLPGLLPRSTLRHLLHVHPRRPGRLRGSPATALPGRGGTRRRQAGDRLAARPAQPGGLLPGLSRACRGSPQGAPFHRVDGRAPGAGATLSGPPPDAPRPGLTFPLRGTIFTLTRFTSERPMLTGVTVRIRLLVLALLPLTMLVTVIAMALANASRLDASFQDLFNNRMKPISQLKIVADAVAVSVVDALHKYRAGVFDEERLQQELSGALSRIEKSWADYSADHRTAAEKEIIESLVPTLERVKRMTLAYGEQARAGSLRNVEAGTFNREMYGAFDPLGTALSTLIDLQLSEGAKLNEQMEKRYDSMRTTFLLIGAAALVLIVAAAWFISLSIMRPLSDLRGVIRRVQDSSNLTLRADARGRDEVSDTARAFNMMLESQQALLRHLAETARKLTITSDEMSAISNQVSHVATSQGDQTDMVATAVHQMSMAVQDVARNAQAAAASAESANSEAHTGTGLVHANLDAIQGLSVMVGEAGAVIDTLRNKTEEISTVLEVIQNIAQQTNLLALNAAIEAARAGEAGRGFAVVADEVRSLATNTHKATETIREMIEALQAGASSAVSVMQQSREQAQVSVQRAHEAGKALGLIAQAVEGIAQSNAQISTATEEQTATASEVSQNIDSLNASIGEVAEGAVKTSTSSVELAKLANGLEQQIQRFTV

SEQ ID NO: 32716 - protein, 410 aa, Pseudomonas aeruginosa
RPRRRRQGEVNMAESVFAERIVQNLLDTDFYKLTMMQAVLHNYPNAEVEWEFRCRNAEDLRPYLAEIRYQIERLAEVEVTADQLAFLERIPFMKPDFIRFLSLFRFNLRYVHTGIEDGQLAIRLRGPWLHVILFEVPLLAIVSEVRNRYRYREVVLEQVGEQLYRKLDWLSAQASSEELAEFQVADFGTRRRFSYRTQEEVVHILKRDFPGRFVGTSNVHLAREYDLKPIGTMAHEWLMAHQQLGPRLVDSQQAALDCWVREYRGQLGIALTDCITMDAFLDDFDLYFAKLFDGLRHDSGDPLAWAEKAIAHYRRLGIDPLSKTLVFSDGLDMPKALQLFRALRGKINVSFGIGTNLTCDIPGVEPMNIVLKMTACNGHPVAKISDAPGKTQCRDENFVAYLRHVFNVPA

SEQ ID NO: 32717 - protein, 372 aa, Pseudomonas aeruginosa
REPEHATDPTRHRPSPAGPAAVPVGGRRAGADRPAHRLHPAVPEGFRAEDPGAGDQRRRRLAHRRPAGPARRRATARADRRPGLPLHRRAPALPGAAGRGRCPGLAGDHPRRRRADRQHRSVGESPGGTAGSPGRTRAGEERLRHRQYQGAHPHGRPVRHRRRPRRPGDRHRPCRRGGHGVLHQVRRRRLRPGSAQRPGQASGARPRPRPRRSGEPGGEDPHRRPRGPAPRPSGRGFPRRHLCRDRRLPARPAAARGSCAGDRRHLPQDPAQARTAEGALSLPVRAAGPSSTGLCRGRECACRNQVFKSARRRARRKLYPCEGQPCAPVSPPCSSVSCWPARPADTHPRCSRRYGSSTPSATAIRTTAKASD

SEQ ID NO: 32718 - protein, 274 aa, Pseudomonas aeruginosa
KSRLPDRAPSSTDSGQTRTGRGGASSGICPAFTTGNSCFSTDVPLRACDATSGNASHGLVEALPAATLCAFFHPRQESIMTLRSVCVFCGASPGASPVYQEAAVALGRHLAERGLTLVYGGGAVGLMGTVADAALAAGGEVIGIIPQSLQEAEIGHKGLTRLEVVDGMHARKARMAELADAFIALPGGLGTLEELFEVWTWGQLGYHAKPLGLLEVNGFYDPLLTFLDHLVDERFVRAEHRGMLQRGASPEALLDSLAAWTPSVAPKWVDRTPQ

SEQ ID NO: 32719 - protein, 371 aa, Pseudomonas aeruginosa
NPAGCGDGCRPALYLVRRGARWTRRWPVFSARPATRSAHKRQRPAGRGVGAERETSGAGGLLHDHRLRRHRCREVGAEGVLDHLVGIEIDLPVMVVVAIRAHRQHRPDQVELEDLHVHRRLAEHVGNRRDALLEQGDGRLVVGGTGKLRLQLDPAERVVGEVLDVVAEYLVVADHGQHVVRSVDRRGEQADLLDRAGHSAGADEVADLERPQDDDEAAGRQVRQQSRPGHADGQADRRDQRRQAGGLDAEETEDAHHQQHVQGHRDERTHVAQHGGIDLLPLEGFLHHADGEADQPTTDHPEGDGRENLDAEGEGVLGHHRPERVDLLGTYVDDRRVIHIAHRAQGRSLAPYENRPWHRKGRLRPLARQRP

SEQ ID NO: 32720 - protein, 167 aa, Pseudomonas aeruginosa
VMPLLPSSSSHSSAPASQALPPSRKAAMLSAKKRTRSMRRPIIRKRQPSSRVMSSRAKPDKAARDITSRLRKSSASPRSVRAGSSACMSRCSSSKASQFSPDKRPRTCAAAQCRRRRLAHRLAGQCSSSNARNRHLSNGSPSPGSRPMPPARARALRSASSSPSAST

SEQ ID NO: 32721 - protein, 183 aa, Pseudomonas aeruginosa
SHRASASPCFPATPCSSANSTRPPTRRCTGSRAPGAPAMRWLPTMNARPRRRSPGRPPWHRSVSPESVAVASRNPSRDLAQKLVAKGAAGTGDLVHRQPGAPQLHRVANASLRQVGEVDRQHVHRDPPGQGRAASPDQYRSPGWRGTRIAVGVAATDRADPRRPLGDPGGAVADALAHGHLAQ

SEQ ID NO: 32722 - protein, 247 aa, Pseudomonas aeruginosa
NQLRAQAHGRPQAQFGGAQVGQRGRPVEHDSRPQPVHVGGRDSQHRRRIGQAALVEIQVEQAEETLQLLLGERMVAFVGAGEMADQVQLAHTRMVAQARMPGAQRGRIEAQAVHAGVELEPDVEWNIQAGGEERLALFRALDHQVQAQLPGEGVFARLEAAFQQQDARAGVQGADFRGLLQAGHGEAIGIVVQRGNHFARTVAIGVRLDHRERLALRRAALGQGIVVANGGKVDGGNEGTHGIGSCN

SEQ ID NO: 32723 - protein, 146 aa, Pseudomonas aeruginosa
SIMISARSPCSRTRRRVRARISEGLMPAVSSMNSFLSLSRLIAEVRRGQSSSSSLPERTLVWSIRPSDESIRITIESEGISREYTNTALSVRITAFSTRFMAKVVLPIDGRPATMIRSAGCRPLVFSSRSVKPVDTPVSASVVLNR

SEQ ID NO: 32724 - protein, 171 aa, Pseudomonas aeruginosa
RTAADTHMPAQPYRSDRLLSDDDQLQSGFHVGVQVHGDVELTGVAQRAVGQANFGFFQRVTGSGNGFGDVAGADRTEQLAFVASVGAEGYHQLGELGSTGFGSGLLLGGSLFQLGAACFERSDVLGGGDGGLALRQQEVTGVTALDVHLVAQVAQVGDFFQQDDFHLSLTS

SEQ ID NO: 32725 - protein, 507 aa, Pseudomonas aeruginosa
MFSWLAWWRGERTPARAARGDILEKGNRRSKEDWRIFVQRMEWRGAAPRRPRTRSLQRGALAEDLEQADAGGDRDVQAADAAGHRQPGEEVAVLAGQPAHALAFRAHHQHGRPLEVELVEGLVRLASGADHPQAALLELFQGAREVGHRHQRDHLGGAASDLAHGGVEGRGLVLGHDHRLHPRRIGGTQAGAEVVRIGDAIQGQQQRHALAPLEQFLEHVFAPDLAGADFRDHALVDAFRPLVEFAPIALPYRNTEPGGQLGEHLDPRIMPPLGQPQLLDPLRVMTQQRFHGMHAVDLFPLTHDLALRLRAPVAAGALSAFGLEGPLRCLVGLPGLAAAAGLPSLALPFALLPAGTTLPFFPPLSLPPTRASASSACFTSRLLRTSVLPSISAACASSSGATGGSACTLPALRRGTTAASGLASAGSRSTSGTDAPLRPFGALPAFADLSPLRFLRPIGALSTFPASSKSIFRSSRSTRATTTSVVSPRRKLRPVRSPLRRWCTASK

SEQ ID NO: 32726 - protein, 177 aa, Pseudomonas aeruginosa
PGFSDRWRNRWPGGRARNRHRYHHSDRPGRWTGQRRARRPQTPRRCDSDSHAARRGRNTAASRGSARPANRRSRSARSAPPGHRPAPPPDGHGPAPAHRGRHIARPAHATCRAARQAGLQSAPRPRPPPCAARHRTTAARLRRTALPRAPGRGRYRHGRGPCARPALPPSRAFPASG

SEQ ID NO: 32727 - protein, 628 aa, Pseudomonas aeruginosa
PRARSAGLRRRCSTGRWRRRHRRSERSKTCCPSAALPRTRVLLAQIVDDPRPQVGSAGAATTGGSTGPRSGRGVTTIDHLVQRQVEQVVLPLLTGHQHLAGLAEDFLHGVQVQTLARHFRSLAIFHQQLGEAIRLALGARNHLVAVTVGFFDDALGLATCLRHHAVGIGFGLVLLALLVLAGPDHIVERFLHLTRCLGALDVHLGHGDTGPVGIQEALQALAHLGRHLLAAFGEDPVHGGGAGDMPQRALGRLLQADLGLVDVEHEVLQVADLVLHGQRHFDDVLVLGEHLPLLAVRTLAGDVLLEALVDRREVEVQAGTDRLVILAEAQDDRLLLLVHHIDGVVQPEHGEDRQADAEQAQATALAAGTGAGTVATAFFSTEQPVQAVLKLAESLIQVGRPLAVTTAATTTAAASPRVSIVVVRVVTRLVPSHSALHLVTRNAPAARPPMLPNALPAAKSSDTGFIAKCVAQRTPPAASQRGSPGGSTRPAAGAPAAGYNPPHRAPRTAPRPVRTTGRAGARAAGAGARFRRTGPRQAARRWPGATGRGLRRSAPTARRAPACRSRRAGCAARPRVAGQPCYRPRASAIRWRRSRRAPPAPARPAHPVRARRRRSRAAGGRRCSTLPA

SEQ ID NO: 32728 - protein, 342 aa, Pseudomonas aeruginosa
KYCRSGWLREKVGKPTQPHRCRPLRSTSIGSACSRNAWPHTAPTRRARASSSRASCRAKMVLPLWRRWKATSKRASARRLMTSCRWSNSVFSARRNLRRAGVLKNRSRTSTLVPTGCAAGCTRGCMSRPSVSTCQASPASAVREVMVRRATELIEASASPRKPRLITRSRSSSSRILLVAWRARASGRSSAGMPRPSSRTRSNLMPPCSTSTSMRREPASRLFSRSSLATEAGRSTTSPAAIWFASRGLSSWIRGASLITGPPGRCSGWTGPGRLSGCRWTGCCCYAARPCSLHSAGRSSPGSLRAAPRARAAPWRACPGRAKRRCRYRAAGSAGNTGGCRW

SEQ ID NO: 32729 - protein, 952 aa, Pseudomonas aeruginosa
RSGFSPSRHGRGRAGCRARGWSCRRRGRHAGRSPPAPRWPGRCARPVRASRLPLRRTGSLQTRTALLEQLTNGRYEIGRRQSTPLGAEPLTGGGMQPDRQAGRLERLHVLGQQGTGDARQHVTQAGTSHRRMPLGTDGKSSVRRGDQAAGALQHHHRLVATRQFQRRRRAIRLHLGGRATQQARGLAGMRRQNPCPRPCSDRFQGQQVQRVGIPDLRQRSRPDSAQQGYAPRARWPRPGPSNSTLARSARAQQLVRRRHAMGHDLGTTAQQRPAHVRPRVAAETSPGAAAQGRFPAASSTAPPMPVSPPTTSRWPNSPLCAVRGRAASLGRGISRQAASPGLERLQHDGVATEFVEHQLADPCRRIASEQPDLQADESHGQIRPDRFPQYRAGVGAQAGRNIHRQHRQVGGVGQADGLRKGLAHGTCQAGAEQCIHYYALEHGALAPGLHHDPGRQRGGMRLRRVAGKPLRRRDRQHPHSPTRTLRQRRDQVAVASIVAVPGEHRQRRGLRPTAAQGTPGGVGGALHEFEARRAGSDQARIQVAHLGGGIEGEWQVVVLEGHGHRIDSASGAQSGRIIPIPCRFPSSSLPPMTPQPLADNLSPPDPARLAQSIKDWGRELGFQQVGISDVELGEHEAHLQRWLEAGYHGEMDYMAAHGSKRSRPAELVPGTLRVISLRMDYLPGDTRMAQVLATPEKAYVSRYALGRDYHKLIRKRLQQLAERIQAEVGPFGFRAFVDSAPVLEKAIAEQAGLGWIGKNTLVLNRKAGSYFFLGELFVDMPLPVDPAMDSEHCGRCSACLDICPTAAFVGPYRLDARRCISYLTIEYKGAIPLELRPLIGNRVFGCDDCQIVCPWNRFARPTGQGDFQPRHSLDNAELAELFLWSEEEFLGRTEGSPLRRAGYERWLRNLAVGLGNAPSTIPVLEALKARRGFPSELVREHVEWALRRHGET

SEQ ID NO: 32730 - protein, 203 aa, Pseudomonas aeruginosa
PSRRLPPGPDGSELDEVVAIVAQLGDRLADIVQRQVGVALLEALADLRRPARSQLLEGGDVEVAVVEVAFQPGHVPIEEAAVLADAVAADRRAALGHPLLEEGQGLRLGLGHAHGAFPDPLGQAGLAVLAGIPLVHAGEDFLWLVDGDHRSFGQGVEVTVGDDGGHLDDDVPVRIEAGHLQVDPDKVLRVLHGESLQSLCRAF

SEQ ID NO: 32731 - protein, 356 aa, Pseudomonas aeruginosa
WRRAHVKLAADFSCGRIMAKRHLTRRQSWRIEKIQEERAARAARRESRAVEELEGGDLGPEQTGQVIAHFGVQVEVESADGQVSRCHLRANLPALVTGDQVVWRAGNQGIGVIVAQLPRRSELCRPDMRGLLKPVAANVDRIVIVFAPRPEPHANLIDRYLIAAEHAGIQPLLLLNKADLVDESNAEGIDALLNVYRTLGYPLIEVSAFNGLAMDELRGALDGHVSVFVGQSGVGKSSLVNALLPGVDTRVGDLSTVTGKGTHTTTTARLFHFPGGGDLIDSPGIREFGLGHVSRDDVEAGFIEFRDLLGHCRFRDCKHDREPGCALLQALEDGRIMPQRMASYRHILASMPETDY

SEQ ID NO: 32732 - protein, 521 aa, Pseudomonas aeruginosa
SEYSKSQFAASPTPSPTPMTDRLAAWLEELDRQPLPIPASHYAGLHAALSDSRRSLREIADQLQGSPTLALSILREANRAESARDNPAESLEVALSRLGLARASQLLKTLPSIQDAEMPRVLGQMLLISQHAMQQASGLFGARLARLWQEIHWGSLLTMAPVWALANARPQLLEQWQQRVLVQGEPTLRVERELLGMRLLPICLALAERWRLPQWVIQGYRLLACDRRLLVRALRIARDHQSPLLQQQQLDAQPDLARWLTQPANCTLLANGLAIAAHQSWDGPHMLRWQRLTGLYLGQPLTEVQQQVHMLAAQSARLHARPPLWHPAVALIWPWQASRWRAEAAPPPPPSAEALAEWRQHCAELLREPSPFSNVVQLTACARDALRACGLQRMLLLVADRTQVHVLAQQSAGLEPGQEKLQLEIASSPLLKKLFQQPALLRIGPNNQDQLLPALGEPLRQLFPGPHLLLRSLGNGSRVVMLVLADLGGQPFSDLHAQAFAKTAQCTERAIQQFGRQRRTE

SEQ ID NO: 32733 - protein, 694 aa, Pseudomonas aeruginosa
ALSMAIEKKTIRLLILEDSQNEAERLVSLFRNAGHATRVHRLTSPEDLAETLQQSWDLLIAAPTSECLEPGEALATLRRQSRDIPFIQLVADNSSDAITDALMLGAQDALPQGEDERLVLVANRELAGLAERRARRAAELALREAEKRCQLLLDSSVDAITYVHDGMHIYANRSYMALFGYEDAEELEGLPVIDLIASCDQGAFKDFLKGYQNDQRQTELVCTGVKLDGQEFKARISLSAATYDGEPCIQVVIRGEVDNAELEEKLREVSSQDPVTGLYNRSHFLDLMDAAVQQAVTARKPSTLAYIHLNGYPSLQADHGLSGIDLLLGQLAGLMREQFGEEADLARFGDSIFAALFKGKTPEQAQAALQRLLKKVENHLFELNGRSAQATLSIGVAGLDEKTAKAQDVMNRAHRCADDAARKGGSQIKQYNPAEELAAAAQRGDVIAILQQALETNSFRLLFQPVISLRGDSHENYEVLLRLLNPQGQEVPPAEFLHAAKEAGLAEKIDRWVILNSIKLLAEHRAKGHQTKLFVHLSSASLQDPGLLPWLGVALKAARLPPESLVFQISEADATSYLKQAKQLTQGLATLHCQAAISQFGCSLNPFNALKHLTVQFIKIDGSFVQDLNQVENQEILKGLIAELHEQQKLSIVPFVESASVLATLWQAGATYIQGYYLQGPSQAMDYDFSSGDE

SEQ ID NO: 32734 - protein, 191 aa, Pseudomonas aeruginosa
PRRLSSANRVSAPSVRRSEAPISSSTSSDSPCSSARRSLKLARKSSSPRIARSVIAATFSPTPAALASSSMTSASISVESMSNTASRRLRRNTLSCWKAMSTFNSWATLRNSARSAAGSAGSPRTENSMQPLPWSAGMSSGMRPERRSMWSMFSAYLAVIELTLCSCSAVTRRVSRVTMCRALPWPSTHCR

SEQ ID NO: 32735 - protein, 583 aa, Pseudomonas aeruginosa
APPGKRRHSTRFPAHPRDAEPGICHHHRSEPTGKTRETAARRPGKRVNGPLPLGGRWLYCAIPLFQKTEPPVTRPTSVKPDNFFLLLFRALRQRRVPIALRLASHSLILVALALLIYAWVMGMQFRQAMQQQADALGQSLITQTAASATELLVSNDILSLNVLLNNLVKNPLVAHAAIYSVDQRILAEAGSRPKQSLLGATEGLYSTPITFQEVIAGHLRISLDMQQFQQPMMISLQSMGLISLILLILALYFSLRLGRQISTPLLQLRVWLRDPDNPAPGAELQNELGDLARDLEERLVPEKPPAPEPEEAPLPQNFDDILLEDDEADLRSRKVEASAFEEDDIPLGDALLDETKPVEFTSIDEDPLDQDAFDENGAEAGEQPAAPAAAREPQHSAVLAIQLGAQEQLRRLPRSRLVDLLQRYRDCLEQAARQYKGSLHTLSDGGSLILFHSRDNRADYLTNALCCGELMRALGHALQIEVADSGITLQLQLGLSLGEDLSEQTQADLLLNETVQNALALNQHSRNLLLVERSIADDAVVRERARIRAIASPEGACCVERLLEPYPSMLERQLARMHDRARP

SEQ ID NO: 32736 - protein, 680 aa, Pseudomonas aeruginosa
SSRLPEPVALAAPRPPGPGPRTGRGWPAGGASDQHLGQVALAFQPGLAVTGALLGQQHVHDLQGTGGVLQGELDQPPGIRIHGGLAQLQRIHFAKALEAGDLRLAALLLCGQALEDAVALGFVEGVVDVLAEVDAVQRRHRHVDVAGFHQRAEMADEQRAEQRGDVQPVGVGIREDTDLAVAQLGQVTGTRIDADGHRDVVDLLAGEHLAAVHFPGVQDLSAQRHDRLEFLVPRLLRRAAGGVALDQEQFRAHRFLSGAVGQFAGQRRPLGDLLALDLLARLEATPGVADRQFRQLQADFGVLVEPQAEGVLHHARDERRRLAGRQALLGLPGELRFLHLHREDEGDPFPDVLGRQLDAARQQVAELAEFAHGVEQALAQAVHMGAALGRGNQVDVAFLHRLTALGQPQQGPAHRFLGTFEVAAEGFIGQARQLGDRVGQVGAQAVLEVPLDALAGVLVLEHHAQARAQHRLGLEHMLEAADRKLRRIEILRIRPEMHAGTGIALADRADDFQVAVLEAVGEGHPVLVGVALDAYLDPGRERVHHRDADPVQAAGELVVLVRELAAGMQLGKDQLDARHALFRVDVHRHAAAVVDDFQRVVLVQDHLHALRVAGQGFVDAVVDDFLGQVVGAGGVGVHPRALAHRVEAGKDFDGVCVVSSHGVSIQSKVEKSVSRHSADG

SEQ ID NO: 32737 - protein, 283 aa, Pseudomonas aeruginosa
AILGVCAGRTQARRQGRNGLVDASSPPIHRRKRNPMRLLKFAALGSLVVLLSACQSFFKPGLDDPLPTERLASEHLKPGCQGEQCPLVNIDTLKFPDEPQLDPIVERALLEMTRENNETPLPASLADYERQFLDSAEPGWSSYLQAKVREQHDGLVIIELSSYLFTGGAHGMPGRGFINYDRRQHKVLSLQDMLVPGQEEAFWKQAELAHKAWLLANKLDQDADFQKTWPFQRTPHVALTFGAVTLKYDAYSIAPYSYAHPELKIPYPRLNGIVKPNLFPGRG

SEQ ID NO: 32738 - protein, 144 aa, Pseudomonas aeruginosa
CCSSALRSSMALLGDCRENLARGATGTGGEKDAPARQAWRGHLVPYAGCCGPREAEPDASPIRFNGIRNYPISAPRIGHPDKNPGSLINTGGIRQRENAPPDRQSWSSPAPSRQGRRRSPHVRRHIDPDWLFDQLPRRCLDRHR

SEQ ID NO: 32739 - protein, 494 aa, Pseudomonas aeruginosa
PCPTSHLFQDERMLRRLSLAAAVAAATGVAWAAQPTPLPTKTDLISVYKEAVDNNADLAAAQADYLARKEVVPQARAGLLPQLGAGARVGDTRIAFDERPATVKRNSQVVQATLSQPLFRADRWFQWQAAKETSDQARLEFSATQQDLILRSAETYFTVLRAQDNLATSKAEEAAFKRQLDQANERFDVGLSDKTDVLEAQASYDTARANRLIAEQRVDDAFQALVTLTNRDYSAIEGMRHTLPVVPPAPNDAKAWVDTAVQQNLRLLASNYAVNAAEETLRQRKAGHLPTLDAVAQYQKGDNDALGFANSAANPLVHYGKYVDERSIGLELNIPIYSGGLTSSQVRESYQRLNQSEQSREGQRRQVVQDTRNLHRAVNTDVEQVQARRQAIISNQSSLEATEIGYQVGTRNIVDVLNAQRQLYAAVRDYNNSRYDYILDTLRLKQAAGTLSPADLEALSAYLKQDYDPDKDFLPPDLAKAAAEQLQSKPRQQY

SEQ ID NO: 32740 - protein, 715 aa, Pseudomonas aeruginosa
HHQRTVQFLAGGGQFLRGVEEAAIADQHQARALRGAELGADAGRQAVAEGAVAGGMQPAARRSAGERVVAGIGQLGHVGADESIGRQRGGDPVEDRLVQRLQRRVCRADIRAQARHPRGGRRGVAGLLRQARQQRLQGLPGIAPERYGRGIEVVELARVDIDADQFARQRQAFAPEVGVGHLGAHRQHQVGLGDHLPARRYAQAGPGVERRVRRLQALAGDAGEQRRGQALAQRGKRIAGRQRAAAGDEHWSPGRSQALRRRPQCLGARHATTRAARHGSAPVMGHRRGEHVERDRDMHRARTLAVEHRVGPGDQFGQLFRAQGQGGEGSDRRGHGTLVLGLVQAAPALAQAGAVVDAGNHQQRHRVGVGLADGGGDVGHARPGDDEAHSRLAADPRITVGHEAGALLVAGQHVADAAARKSAVQLQGMHAGDAENGIHAVVGQQADQGLAGGEGLLWLHGQYPHPVRRPSESPFAPQRSCSHSHKREGEPSCPPGLQPLASRINASTASAPSASASNGLTSSSSKRSACSQANSATARIAATRASMHTAGRPRKPLSNGALRRLSRASRIAASVVGRSRLRLSRSSSTSIPPAPITNARPKPSSRLTPTISSASGAPAMRSNKTRSKTSCGACRARLSRMSNNAASNAASLRRPSATPPASVLCGSAALTALSTSGKPRSRAASRAWPGVLSTPWGSGRPKGFSACLDCHSSSR

SEQ ID NO: 32741 - protein, 178 aa, Pseudomonas aeruginosa
KAVRKLFAAPLNRPLSRLRRGSRRGAGLRRRRGAGYPGVRPRLAGRPRPRPGPRAPARPGRRRAPPGPWSGSFRTGDGRCSPPRPGPPGPGLRPAAATARPGFPAGCPAVRRACAAPAGGGGSRAFAGPARPPPQAQARWCRPRPARGAARPSAGACRARPACPRRSTDAPCPAGCWR

SEQ ID NO: 32742 - protein, 809 aa, Pseudomonas aeruginosa
TAAPATAGAAPTLRRGRSPGVRAVAGEAPIVAHAVVQPTLDAAVVAIATQGPVDLVHLRRQRRVPRDRHPQVVHRQRFGQRTDVLAAGQALGEQRAGAPFVGDVVDALAHQLAEVLSAVGNPFDVAVAADEAVEVRPVAFAEQQPAAIAGEVAEGLDAHRPLAVVEDRHVLAQHRLGGKRQVAIARGRAVGQYQVDPSGGGVEQAAPPVAQHHHLDPVAQRAEQPLHQLRRQPPDLLAVAPGDRRVYRIVAIADGLRSLCQAAQQPSAERQPAGLHGSGVAGRGGEQVAGAVDGDDQLRFGRVVAQLATQAADQHVDGAIAGQPLAVADLVHQLVAAQGMPAVAQESAEQLEFAMGEQGFVARVVDQAAPVGVQQPVAELPEGLPGGAGAGLGMAHPADQILRPRHQFARVQRLDHVIVGAALQADDAIDLVVAPGDQDDPHLGAHPQLAGQGQAVLAGQADVQQHQLDRLAEMGALGKAGFRLLGVAGAEDVIALLAEIGLEKLTNHRVVVDHQYARNHRHHLAPPAGRGVSCSGLSDGGRKGPGRLPLPAAAYPLLNGRSTSFHRTPEAAMGARLQAIHPGLANLHALPRREGRGIQPRLQPQPVEQGAEADGRQFRVEVRPAALLRQLPQHADQQRPVLAIGMVVDPPDRFDAAHRTPERQPGVEQLRIEQLGGEGCLEERREPRAGAARRGVDGTAEQAHDASGDRQVGLGHQRVLAIVVVIDQAHRYPGLGADLAHRGALEAMPLQAGQGRLDQQRLALLWLQTGKAHFLVHPFAAPARRPRPPAGSPDDRRLRGARLTGWPRR

SEQ ID NO: 32743 - protein, 718 aa, Pseudomonas aeruginosa
PTTTRPSSAWTGARPPNASRTAPSRTRQGKTGCGRALAARRNGKERFMCVSSCSCCGVDRSEPPGSGHGTETIQSILKKQVDFLLMVNSYPVSEARRENNKKDANREFPAPVQPPGNPGQTPEKPHHVERPRHVDAYRQPGQRATRRLSPRPGPRRRRTDRHAGGGGPRQRALHLARADGHRRCLHPRLPAGRRGLPRRRLRGAVANLPSRARDHGVRRRPAGGGLFRLGLAQRTVPGDAARTRPAADRRDRRRLRRRRAPPARGRTGRGGGGRQPRLPAGAIPQPAGEPPQGWLQRRPRCPPAFPPRSAGGGARGHLRGLHRRPAPVRRRARPRGSQRKRVAAGGRGGPGRAGLPAHRRRHFGLPRRRHSYRPADGHRAGLPGPRSQYLQGAPGDPAVRHRAHQPAPGGRGHPRPRPGRRLRHDPRADLRPADAEQGRGRAQRRRARLHRLQPGLHRTFPPRLSDLLHPAPGNRPRADLRNAQSALAAQARAGRRRRPGGDEGGGGGGTARPRGSALRGRRPARRPGQPGATAAAPRGIRRRLHQPATGDATGRRRGTPQHAGRPRAGGARTAGPGDRRHRRRTLLAAFRARRRAAGGGCLAGAARRGAGRSLGAGHRLAGRLDRPRYRGKACTRGPPGTPGGERHPLRREPAAVRARPVGRRTAPPGYPGHALRPPVRLRRYHGVHAAQRQRRGDAVRGGRYPGAMPGPPAGGPPG

SEQ ID NO: 32744 - protein, 260 aa, Pseudomonas aeruginosa
QPARPGGGVADRRLPGPPHRRGGDLRRAQGRLEHLSGAAAAPSTGPGPAPRMPQTQPGPRRMPRPSPPDATDTPRSETHFLGTRIRGLRKRRGLTLAELAAQSELTAGYISQLERNLAYPSIPALFNIARSLGVTIQWFFASEAAVDPADAGYVVRRNTRMSVHYEDGIIDELLTPQPSRQLEILHSRFPPGTYSQQSYSHEGEEAGYILSGIFELWVGDRHFQLREGDSFSYSSQEPHRYGNPGDSDTLVLWVITPPTF

SEQ ID NO: 32745 - protein, 284 aa, Pseudomonas aeruginosa
LVDAGEAFRMARHQDQQRVGTRFQQAPVGCQDDLVLAGMGAGGDPQRSRRRVPFLAQGGSGQRQLRVDAQVELDRAGHADALRTRAETTEALGLGLGLHGDPGQLGEHRPGQPGEARVATRRALGQARIGQRHRDPAHGAGMDMVGPQLGFHDHRQARPHPVEEARRRPGQVVGQVAVPDLLAEQCADALRAGRGHAGDGDRQLRMALQQRPHHRRGGDALAHRDSVHPDAAGRHLGQGQGKTLADALGIGRCLARAPPQAQRHQRQAEVEQQGIEGTVHGRAA

SEQ ID NO: 32746 - protein, 232 aa, Pseudomonas aeruginosa
  UNSURE (40),(45): Identity of amino acid at the above locations are unknown.
FAAWRNWPATACSPANASNRCANAGNWPACASTAGRIVPXAWCSXPVAGNEALLRELGLEQPAMQRRPLHMVMVKAATLKPLYAHCLGAGPKPRITVTTHPTRDGQSVWYLGGDIAEADGVARDEAAQIAEARRELAKLLPWIDLGQAQWATLRVDRAEPAQSNLLRPDNAFLAEQGRLLVGWPTKLALAPDFADRVCARLEEDGIRPSEHAALPQLPRPPLAEPAWEVAFA

SEQ ID NO: 32747 - protein, 253 aa, Pseudomonas aeruginosa
TCRCSRRSRKSPRNAWWRPPAAGSAGASATPGCRRPTRVRCATGRTATSSSPRCPAPPVRCKPAACACWSAHAPTYTCPRPRCNWSTTCAWSCRAMRASRASTMSTSGSRAVRWWRVWTVGAPISTCCRWTRGAPPATCSPCARASCALRPPAACGWPRALPYRTAGWCMRNASVSATGWHCGHPATATRPAVGATAPAPEPGGLCRPFYFNWLEDLPSRRRATMSSWICWVPSKMSRIFESRAHFSNSSSSA

SEQ ID NO: 32748 - protein, 688 aa, Pseudomonas aeruginosa
KHEITAGLSSSLSKTFKYNPTSCHPPPASSPSHSRRRVKKMCGISGFIQRHTEKSQMVQIIGQMTDKIIHRGPDDKGYWLDHSIGLALGHRRLAIQDLSTAGHQPMPSACGRYVIVFNGEIYNHLALRALLGPHPWRGHSDTETLLACFSVWGMEKTLSNITGMFSLALFDKETSKIFLIRDRLGEKPLYYGWQGNCFLFSSELKSLTVHPEFQKEIDRDSLAAFLRFGYCPTPNSIYKGIKKLPPGHYIQLNLANATPGELMDPLPYWSLSKVIAQGIHQPFQGSDSEAVDALHRQLSASVTSQMLSDVPLGAFLSGGVDSSTIVALMQARHSRPVQTFTIGFDEPGYNEAEHAKAVAQHLGTQHTELYVRAEDALAVVPCLPGIYCEPFADSSQIPTYLISRLAKQSVTVALTGDGGDELFAGYNRYLTACQAWNRLQQLPLVARMTLAKLLSALPPAMWDSLFSLASPLLPSKYRLRTPGDKLQKLAGLMAFSSEEDFYKDLVSHWKKPTNLVIGSEESASVFWNLDSLPEMESFEQWMMAMDTRTYLADDILAKVDRAAMATSLETRVPLLDHRVVELAWKMPLNLKIRNNDGKWLLRQVLYQHVPRELIERPKMGFAIPLDTWLRGPLREWAESLLAEERLRREGYLRPEPIRRAWQEHLSGKRNWQGPLWNVLMFQAWLEHQ

SEQ ID NO: 32749 - protein, 320 aa, Pseudomonas aeruginosa
RESALADLLDDGGGGAVLHQAEHPYLAAVGLDDLRADHLLDAVIAALDQHVRTHLLEQALGSVFGEAHHPVHRAEPGEYRHAPVHRVDRPANALQASDRGVVVDPDDQAVALGARLFEVGHVAGVKDVEAAIGEDDLLAVGAGVFDCQQQLLQAQHATLGTLLALHRATQFGRADRRGTQLADHDAGGQVGQAHRGRQLLAGGKRRGQGGDDRIAGTGDVEHFPRPRRQVQGRLAIAEQGHAMLAAGHQQGTEVEFAHQRLALGDQFGFVGATADDGLEFGQVRGDQAGAAIDGEVLALGIGQYRNVARPRRLDQHLVVL

SEQ ID NO: 32750 - protein, 262 aa, Pseudomonas aeruginosa
RALAVVGQHQHLDLGQQRLDVHGQGRRVGAERFLEVDPQQLLVTTHDPQLDDGRLAIDALEARVHSSGLEAVGQAVGGLVAAGDADQQGLRAQRGDVQRDVGGAAGAVLVLFDADHRHRGLRRNARSRAMPIAVEHHITDHQHRGLVETGHGQLHGNSKQPLGADAQFISRQAPAPAHPVPSRAAAHNGRSAPAARRGCRARRSAPGPSPGSGRPSRWSTGGGRSPGWCAPSSLRPAPPGYAAPTRCPAPRSPRRGSAGARP

SEQ ID NO: 32751 - protein, 250 aa, Pseudomonas aeruginosa
HRTSITLPGRRVGVRWRAVRSGARMRVIDYPSYLQLRDNAEVLEADGHGDKVLRLRDGSFLKLFRRKRLISSAALFPYAERFARNASELARRGIVCPKVLDVLRIPHIQRDAVHYEPLPGQTLRQLDRNDPECGDTVRTQLGELIAALHAKGVYFRSLHLGNVVRTPEGRMGLIDIADPAGPALGAQRRPAHSQFQAPAALRTGSNLVPRRQRAPGAQGLSPQQPGPLDTRAAPQATATGLSKECSQLPD

SEQ ID NO: 32752 - protein, 805 aa, Pseudomonas aeruginosa
SPSSFRLLLSGKNTSPGLLQPSGTLRLAQRGPHGLDDTLTDSGEAESFDGQRLAASRDPLGESRIEAQDRELFLDVRHRAIQHDILHVPETQGLVFPLALVVGQQYATAGHRLEILDHVFAHADIRADEETDAVERTQVLLAGLGLGHQQVLHSAQLVEQRLASTVSHAAGTADEAQLDIAREAQVMQQGLVVALGHEYRVESLLAQAFADRMARTDHPCPGQAPVMGAELAGVLAGNVVLVGIVLEDHQVGHAADEADLAHFLLETEEEQDAVVARDIHVLAEVAAQVGLLLAAQPAGIALAMGGDAVVQAIQDRALLFLDQKQNFHQTFILAAAPKQHGGSNLAERSTQASRLPIQRLHPEQLVPTHRLAHELVLAVSRPATPGEPALQTAAQTALERRPGLQVVHHAQGHGLVHLARALQRQRPWQQRRAFFGQRWQADPHVRIAHRPAIVVVQVIGIVQQCLRLPVQALERLAHSLLGADMVRVRIEMRMRQDDDLGTCQQDQLAEIGQQIVPGRQAVGIAGQAQAVELAERTDIGEIGLTGRHHLARVRLHGRQLQAEITQLHAALGRHPTPRRHGLAIPGAQAALQARRSYSVEAHAAVMLGFDLAGGQGHDPGLASLAVEAEGGQLGVVGMRSDDHHPPITVVGMARTPQGRFADQPAMPAAQANPALAQRPGQSRQVQVAQAVHPTFESLGIGLRATFQQHRGFEEAPQPASAHADAKHQRIAFAQLTVDSQTAIRQAYRQRLDPFRETVAVVLARRIEQVIGEPGFVGDPQGHEEDRQQPGADQQTDGQQCQQRNQ

SEQ ID NO: 32753 - protein, 429 aa, Pseudomonas aeruginosa
ADPLVASMTLEQLLLACAHASDLEDRRRMAPAILVFAVGATERIAQGFAQRSRILPGGLGVQVTEHAARAELAGLRIDAAVDVLDAEPARRFGAIQYLDRDGLVVEQQDRAAQQFAQPLEDLGHALRAGGRETPATLEQFKIDGSELGRGEAVCLAHLATGLLHQAHFAPLVIAELLGEILGSTSESQLLGLRAQRDDVPLMQRRQVASRMAEGDAGIAGHRQDQFGVAQVVQALLAAPLEHVLGQRQVAAPGRDRRNQFASALPTQVTHRDSSHFGELLDHQRVGRDAAAETLPGLGVGRRVHFAPTAFAEGAQPVQHADSEAKPAIVGRRQNSRRTAASEKRVSRRSSMSRAQASRWRRSSAARWVRPSARAVSSPSGKRMPTPSTTSRAPPQAVAISGTPATMASSRTMPNGSWSELRAKASNALK

SEQ ID NO: 32754 - protein, 587 aa, Pseudomonas aeruginosa
QNCRTRGSADRVIPVHALLHDQDVLHDQVLQIGAEEHVQGVGRRADHRFATAIERSVQGHAVAGEVLQFLHQVVVARVVLALQHLGAGGTVFVHHFRHSLLPLFVDFEGEGHERGRVVDLEHLRADGIQHRRAEGPPALAELDLRIDPVGHARHARAAENGAATEGTRTELHASLEPGHRVAVGKDPADTPAAVVDLLPLRPGLVTGAGGDDVLVGILRAEVDVLHLLHRHAALVRHVGRRADRGAGVAGRRLDEQLLHFGARDDLLVELDVQRAAAGESDLAGLADDIAEVVVHHLQRELLEQRLDARGVMDVGIVGDVAFALGPQPLDQLGREVVALAFLLVAAEADDVGIIGVDHQFAVLELGETGEIVLAGVTVGRHAHDLELAVEHVEAEVLGDRAVQAAQRIRIVELLDLVDPTVLAPAEESGGVFALAVDAEDRGLFLEPRAMVGTGGVGKVVLDRLDLDFLQVEAELLQAPLDALVVTLVAAVAEQDRIQRAIRRVGVALGVVPAGLFHDADGSEGNRYHVDIGRLDPCLLQAELRRFVGHAVLRVLVAHEALFLDGRDQLAVDVQGGGRVMAYGARQA

SEQ ID NO: 32755 - protein, 447 aa, Pseudomonas aeruginosa
DTGGRRGATGCPRAGRPARGPLHAARQWLPGLRRAPLAGHRPAAPGPPPHARRHRGSAPRRGSRTAASRPRPAAARRPAAPGWSAPGPRADAPLPVRAGNAVRPCRPPAAWPAPCAHAIRRHRRSAARAAPAADCPGAVRQRQRHPPGSPAMAVAGGARRLAVRPVSSARLLAPTALVEKAIPLLDLGRVEGFVDIGGDEFVHVRFAPVRGTAQHRLQVLDLVAAAEPDRAGLLQVDQAGLEDTIGPLAEEYMLGIEATMHLSGGVQLARQPANRPENRPAPLFGQVVPGRQPGVQVLPTVQGTGQEDRLALSADRLLGEERRLQGGNAQRPVALDVAELAGEGRLAQRMAQAAGQVVALALQVVGGVAQVEAVDAAPATPLGIRFVHGVQLQGPQGVEAVQTVALEQVVVLRGDENAHSRPSKKATTWRIRFLSDSFRCRRRRYCR

SEQ ID NO: 32756 - protein, 306 aa, Pseudomonas aeruginosa
SGRLSPPCHTLLRCLLDQGTPLGVGLGLAADQVEIGFLQLFGDRATAAGADLATVHFADRRDFRGSAGEEGLVGDVHLVAGDALLDQFKTVFGGQGQDSVTSDAVQAGGDFRGVDHAILDDEDVLAGAFGHVAFRIEHHGLVGAAGDRFLEGQHRVDVGAVGLGAGHRDVDVVAGEGTGAHLDALLQGFLAHVGAPAPGGDDHMDLQAAGAQAHAFASVEHHRADIGAFQVVLAHGGAGRLVDLVAAVRDLHVHDVRGVEQPVGMRLQAEDRRALRGVVGAHALEHAHSIVQGMGQHVRGRVAPLH

SEQ ID NO: 32757 - protein, 84 aa, Pseudomonas aeruginosa
LRCATRRDRAASPAPRHVPPRSSPAPAGNRPAPGRGPTPGAPRSRPPAPGSAGRRPANSPAGRPRRSDAGACRPRRGCRMASAR

SEQ ID NO: 32758 - protein, 148 aa, Pseudomonas aeruginosa
CAVAGVCGNVAGADRVRPRRRNPPAAPATGCAIRRARGGSPARRVRPDPAASPGRALPARRRNRWPRRPVGNPPGAPRARPPGGPGRRHRGRRQRSGGQSRRVRRRAAGWPADSPAKAGSWSILFGLPTEDHRLDAQRRKGSTSGLIA

SEQ ID NO: 32759 - protein, 922 aa, Pseudomonas aeruginosa
NYKSPGTPPENIQELAAVAHEAGRSPMASDSGSLSALEQAMQDLDPVETQEWLDALESVLDREGEDRAHYLMTRMGELASRSGTQLPYAITTPYRNTIPVTHEARMPGDLFMERRIRSLVRWNALAMVMRANKHDPDLGGHISTFASSATLYDIGFNYFFQAPTDEHGGDLVFFQGHASPGVYARAFLEGRISEEQLENFRQEVDGNGLSSYPHPWLMPDFWQFPTVSMGLGPIQAIYQARFMKYLESRGFIPAGKQKVWCFMGDGECDEPESLGAISLAGREKLDNLIFVINCNLQRLDGPVRGNAKIIQELEGVFRGAEWNVNKVIWGRFWDPLFAKDTAGLLQQRMDEVIDGEYQNYKAKDGAYVREHFFGARPELLEMVKDLSDEEIWKLNRGGHDPYKVYAAYHQAVNHKGQPTVILAKTIKGYGTGSGEAKNIAHNVKKVDVDSLRAFRDKFDIPVKDADLEKLPFYKPEEGSAEAKYLAERRAALGGFMPVRRQKSMSVPVPPLETLKAMLDGSGDREISTTMAFVRIISQLVKDKELGPRIVPIVPDEARTFGMEGMFRQLGIYSSVGQLYEPVDKDQVMFYREDKKGQILEEGINEAGAMSSWIAAGTSYSTHNQPMLPFYIFYSMFGFQRIGDLAWAAGDSRAHGFLIGGTAGRTTLNGEGLQHEDGHSHLLASTIPNCRTYDPTYAYELAVIIREGSRQMIEEQQDIFYYITVMNENYVQPAMPKGAEEGIIKGMYLLEEDKKEAAHHVQLLGSGTILREVEEAAKLLRNDFGIGADVWSVPSFNELRRDGLAVERWNRLHPGQKPKQSYVEECLGGRRGPVIASTDYMKLYAEQIRQWVPSKEYKVLGTDGFGRSDSRKKLRNFFEVDRHWVVLAALEALADRGDIEPKVVAEAIAKYGIDPEKRNPLDC

SEQ ID NO: 32760 - protein, 551 aa, Pseudomonas aeruginosa
KERNVSELIRVPDIGNGEGEVIELLVKPGDKVEADQSLLTLESDKASMEIPSPKAGVVKSIKAKVGDTLKEGDEILELEVEGGEQPAEAKAEAAPAQPEAPKAEAPAPAPSESKPAAPAAASVQDIKVPDIGSAGKANVIEVMVKAGDTVEADQSLITLESDKASMEIPSPASGVVESVSIKVGDEVGTGDLILKLKVEGAAPAAEEQPAAAPAQAAAPAAEQKPAAAAPAPAKADTPAPVGAPSRDGAKVHAGPAVRMLAREFGVELSEVKASGPKGRILKEDVQVFVKEQLQRAKSGGAGATGGAGIPPIPEVDFSKFGEVEEVAMTRLMQVGAANLHRSWLNVPHVTQFDQSDITDMEAFRVAQKAAAEKAGVKLTVLPILLKACAHLLKELPDFNSSLAPSGKALIRKKYVHIGFAVDTPDGLLVPVIRDVDRKSLLQLAAEAAELADKARNKKLSADAMQGACFTISSLGHIGGTGFTPIVNAPEVAILGVSKATMQPVWDGKAFQPRLMLPLSLSYDHRVINGAAAARFTKRLGELLADIRTLLL

SEQ ID NO: 32761 - protein, 466 aa, Pseudomonas aeruginosa
QALDANPPGEANPTKNRAFPAAPQTSDRPAVFSRIRLTWALPGRYRVTCQTNRHNAPFACTPSKRVEASPSLSTWNQPRMKSHPDAASRSAAEVVTQLPVPSRLGLLRFERLNEPSWALLFLDPACERQLGLPATTLCALLDAPYASLMEPEARHRLHEQIQQQLVKRPHYQVSYKLHTPNGVLTMLEFGEAFQQHGRQLLHGYLMVEERAESAERSEQLLDLESQNLRLKASLDLYQRSQDDHLQHLLRSRTQQNLIVRLARHRYLSSDPLLEAAQLITQAACEAYGTARAGIWRLLDDQRLEAVTVYRRDLDQYEKPQSIDASRYPAYLEAVHSGRAIDAHNGPARPTHPGTLQGLPEAAGRQRPARRHHPHRRRGGRRAVPGTRRREPHVAERRDRLRRGTRRPVRAGPDEPRATQCLQRPALVPARGGTERQRLPADRPRRRGGIRQSELHLDHPVQRRRSA

SEQ ID NO: 32762 - protein, 409 aa, Pseudomonas aeruginosa
QPRPPDRRQAAGQPGPALAQLPRRRRHPGALRQQRVRRAARRHRGGKGRKHCRAGPAHARQAAVRRQPVDQHHRLHRPGQRPAARLRPADPDEVRRPGAAQGQGQRQAPGPGVHRGADRRGQLQAVRREQPAPRPGAERTGGALPAQAVPAQRPVARPGSPAALAASGKRHDPPGPLHQRGRGNRADRADRQVGDPRSLSPGPRAGRGRAGRAADRHQPVAQAVHRPGPGRLDRGDPPRREHPGQPAGTGAHRKPAAGRHRRYPPATRTPEEPRPDPGDGRLRHRLLVTELPEEIPHRRDQDRPQLHQGHSGQPGRHGNHLGGDRHGPQPQAQGSRRRRGERRATGLPPAQPLRHRPGLPVRPADPQRPAQYQSAALSLPHPALIAQASPAGAERLYSLCSSASHSPTP

SEQ ID NO: 32763 - protein, 347 aa, Pseudomonas aeruginosa
EYAPRTPAGPPAGRQGPERATGGDHPPRRRAAHAADPEGLCRRRLRPGPVRRAPVRRQPDPGRRRTAPPGPRPARPADPDRQVLALGVLPEGQRAGDPDPRRPRLHPRIPGGTVLPRQSPEPDPRRHPRHPVPRPAGTQGRAEQWRRPAPADPPDPGRLPARRSPPIPGRPAPAAGTAGGAAVRGDPGTARRPDAGPGQPGPGQLGAVPESVRPCGDRLALAGAGDPRRGRAGSRRLRRRRLLSRQVAGRTLLPDLGSAWLPPRTGAAGGPRRRVFEHAGRMVLILPALSRPGHVRGFFMSGHGRRVAVAWRPRRRVRAHSPGQRESLGIPSKKTAAAPLQSAKSAG

SEQ ID NO: 32764 - protein, 1162 aa, Pseudomonas aeruginosa
SFRKAAQGPDFSSDFLSNSRSEAPCGASEPPLTCIHPSSSLFSTMPALRSLIAILFLGLCLASPPLLAQSEPPSAEAVQQSLDKLAERKLAEADQKVAKASLEQTLKFLAARDEALQSLEDLKKRLSDAPRQIEENQRELERLKKTKERPVSERYSGESAARLEMLLNDRTTQQAEWQKALGEANSLSITAETRPERAQAGISSMQARILEIGSLLKAGKESGKTINADRRGELLAEQAALTVQSQLLRQELAGNNLLQDLGKSQHDLLTEKISRLEKETLDLQALISEKRREQSEKTVAELSKEGAQGAGTDSLLSQENAKNLRLSDYLLRATDRLNVLTRRNLETKQQLDNLTQSNQALEEQINVLRGSLLLSRILYKQKQALPKIKADQSLADEIADLRLGQFELNQERDKLATPQQYLDDLLAQQPSEQVTPELRKDLDTLLATRSELLERLNHELNALLNEAITLQLNQKQLLSTSESLRTTLDEQMFWIPSNQPLDLSWFKMTPTLLKNQLTEIPWGSGVRELGEGLVDRPLLFLPLFLLIAALLWKRRYLYDKLAELNDDIGHFKRDSQLHTPLAILITILLALPGTLTFAVAGLALLLDARGQNATLGSALLEMAQVWLLFYTAHRILTPGGIAERHFHWSREQVGFLDRHLVRLGVVVLALVGVVTVAEHQPASLADDVIGIAVVLLGYAAMAWLLSRLLFSSPGDERPSLIKMIVGILFTALPLVLFVAVCFGYYYTSLKLTDRLIDTLYLLLLWFVIEAAFVRGLGVAARRLAYARALAKRQNAAKEGVDGETNVEEPTLGIEQINQQSLRLIRLALLIGFIVCLYWVWADLISVISYLDNVTLYQYTAGTGEAATSVPISLRDFLAALAIAVVTVALARNLPGLLEVLVLQRLTLAQGSAYATTTLLSYAISGIGIVSALSTLGVSWDKLQWLVAALSVGLGFGLQAIFSNFVSGLIILFERPVRIGDVVTIGNLSGTVSRIRIRATTITDFDRKEIIVPNQTFITGQLVNWSLSDTVTRVTIKIGLAYETDLPLARKLMMQAVKENPRVLRDPEPLLYFLTISASTFDYELRFHVRELGDRNPSTDEILTKIATSFREHKIDMAFNQVDVFVKNLQGQQVQLFVGEPQHSGVGNPPALKGQDGPAEPTR

SEQ ID NO: 32765 - protein, 508 aa, Pseudomonas aeruginosa
TSGPGRPPAIPSTMLGNCRRPLLKSLDDLDFDNRFARLGDAFSTEVLPDPIAEPRLVVASPAALALLDLPAETSDEALFAELFGGHKLWSEAEPRAMVYSGHQFGSYNPRLGDGRGLLLGEVINQAGEHWDLHLKGAGQTPYSRMGDGRAVLRSSIREFLASEALPALGIPSSRALCVIGSSTPVWREKKESAATLLRLAPSHVRFGHFEYFYYTRQHDQLKQLAAFVLEHHFADCNAAERPYAAMFRQVVERNAELIARWQAYGFCHGVMNTDNMSILGITFDYGPYAFLDDFDANHICNHSDDAGRYSFSNQVPIAHWNLAALAQALTPLVEVDELRASLDLFLPLYQAHYLDLMRRRLGLGVAAENDQALVQELLQRMQGSAVDYSLFFRRLGEETPERALASLRDDFVDREAFDRWAEAYRRRVEEEGGDQESRRRRMHAVNPLYVLRNYLAQQAIEAAEQGDYTEVRLLHQVLSRPFEEQPGMERFTRRPPDWGRHLEISCSS

SEQ ID NO: 32766 - protein, 348 aa, Pseudomonas aeruginosa
EKPIIFAATLIPACSTTSCQAPCRMKIRDLDLSQSSINTEHQALGLPPVEDFVTHPDDHPVLRAAMWAAVLILVGLLAFLAWRLFFDNGGSSGFEIIEQALTSRGFWSAVAVGFFAQVIDGALGMAYGITATTFLLSAGATPAAASASVHIAEVFTTGFSGISHVKLGNVNKSLFLRLLLPGMIGAVLGAVLITRFDGHQLKPFISAYLLLMGLYILSKAYRHVIKRRAPRHVAKLALFGGFVDAAGGGGWGPVVTSSLIGSGSDPRTTIGSVNFAEFFLTIASATSFILLAGQPDTWKMVAGLVFGGLFAAPFAALLCKKLSPRTLLVIVGTLITLISAYNIYIGLR

SEQ ID NO: 32767 - protein, 444 aa, Pseudomonas aeruginosa
PARRAFPCCVLPICPKERCMKLETLAVHAGYSPDPSTRAVAVPIYQTTSYAFDDTQHGADLFDLKVPGNIYTRIMNPTNDVLEQRVAALEGGVGALAVASGMAAITYAIQTVAEAGDNIVSVAKLYGGTYNLLAHTLPRIGIQARFAAHDDIAALEALIDERTKAVFCETIGNPAGNIIDLQALADAAHRHGVPLIVDNTVATPVLCRPFEHGADIIVHSLTKYMGGHGTSIGGIVVDSGKFDWAANKSRFPLLNTPDPSYHGVTYTEAFGPAAFIGRCRVVPLRNMGAALSPFNAFLILQGLETLALRMERHCDNALAVARYLQQHPQVAWVKYAGLADNPEHALARRYLGGRPAAILSFGIQGGSAAGARFIDALKLVVRLVNIGDAKSLACHPASTTHRQLNAEELARAGVSDDMVRLSIGIEHIDDILADLDQALAAAAR

SEQ ID NO: 32768 - protein, 180 aa, Pseudomonas aeruginosa
ADRSVRASVSVLARPGRPASLAGIPDMESAMPLPTELARHLTEEKIAFVQRSGLRAEVLEPGYVRLRMPGAGNENHIGSMYAGALFTLAEIPGGALFLTSFDSARFYPIVKEMTLRFRRPAKGDIRVEARLDAERIRQLETEAGERGKAEYSLELQLTDEQGEVVAESTALYQLRSHARP

SEQ ID NO: 32769 - protein, 353 aa, Pseudomonas aeruginosa
PSHGVRHDPPPPGRPRPHPGSRRRPRPRRPVGPPARCAGQPAARVRPGAIGVGGEDRQRHAAAQAQGGRPRRGQRHPPVQGPTDRRHPAADPGARTGPAADGRAPPEDLRTLRQHHPRPGGAAQPGASAARRARGGRTLPPGAQRPGLFPVRLYRAAPGLPPAAGGSRPARPARVRVPRRRRARPAQAECRAPGHPGRADRTIAERRAGAPAGRRAAAEPRSGSRRAAVQPGRRVEAAPAGAARPRPAQPQRADAGAARQPGATLPAPAELRRPGYLVEALPQRLLSFRAARATRRTAGSTCAAVRGRSAGYKPGATRASSPNSSGTPAAPAVPPPPARRAVAAAGWRAAGTG

SEQ ID NO: 32770 - protein, 233 aa, Pseudomonas aeruginosa
CSPACCYSPSASSARTRWRAAGSGAAPCAPRARPRRSTCSATTSARAWPAPSAGCSGITTAGTASGCSSARCWWSRYWSRCTWRACRPCLATPWRRPPTEFERRSPGAFTPTRSVLRSVPPIAPTAARPAPGRAHSAESAPPPDNRGFPTSDPGRHRRRHTSAVRSARKVPATPPSPPIARTLRWPPSSPSVPGANRPSPAPRTAGWSPRSPDAPPGSAEARPAGRRGAATPG

SEQ ID NO: 32771 - protein, 85 aa, Pseudomonas aeruginosa
PVLPSTQTKPPVMYSQQWSPVPSTTAWEPELRTAKRSPAVPAANSLPPVAPYRQVLPTMADSWVLNGLPLGGVITSLPPVMPLPT

SEQ ID NO: 32772 - protein, 271 aa, Pseudomonas aeruginosa
SLASPSRYRCRPPAFHTPKLCPAVPLKRNTTGALAMPWLPCRRAISPDTRAPMDRSQLQMSSSYSPPLRPSMAAFDSSTIFSASRPWSNGGFFSTSQNCGLSAGISSLPSNGARSRFCCLAVSPGRISSRSVRPISSPRLRTPRRASHSRVSVAMKVKKLITIAVVPMKWSLRNLSFCVATPVAQLFRWQMRRYLQPRAIIGAVPKPKLSAPRMAALITSRPVFRPPSVCTRTLPRRSLPRRVWWVSARPSSQGEPAYLIEVIGEAPVPPS

SEQ ID NO: 32773 - protein, 191 aa, Pseudomonas aeruginosa
DNAIRRASAGRQLAQAFENFLDDQARRPFVGLHHHIGDFAVERIAQRHQVAEDLSRVGLLQQGAVAVPRRARDLVLDRGMQVHNPATGAQHLAVTVAHHRPAAGGDHHAVGGAEFGEHGLLALAETDLALDIEDPWDIRAAPLFDLLVGVLEREMQLLGEQAPDGALSSTHRADEDQVDHVVRYQRPIAMA

SEQ ID NO: 32774 - protein, 513 aa, Pseudomonas aeruginosa
RPRTAGTSATARWCPWAGREPRPCRTADRRNRNRRRIRPGWRAAGCSESGGLSFLQPLVVVAIGLGQDAHAQLGRAAGRDRLDLEVMQGDDPRQAGHAADEGRQVVVAADHADLDRQLDVELLGNLGKQLDFLELQAAAQAGTSDVLEQPGYLGVAGQLPQQGAKGLFHLLHLCLVGFQVRGLEGLGGELLLERLLFRGLLFELSLHVTQMEVVAQRQDRRGQQHADDDLDRRRPGTDVVQVEIVDIDLAQTFQGTGQTHFLAPCATPCFALASSSPGCVCCTVSWNTLAWSTAPWVTALTSFRVGAVSHSDASMLRMRLETRLLDSAAPAMAMFLPVIFRSVKYTPSGKVRTSWSNTRPMMGRLPCRSWMIFIRSSNCWRRDFSSLISLIRASSTTISLRRKSLRAFWFSMAAVKYWSPRNTSAADATRTPPRITRNCCLRCSRSSSRQGRRLIRAISRNSSTPGRRRSSTPERRWPGRRHSPCRSAPCRRTGWRPGSGCRSSAGSTDRDPG

SEQ ID NO: 32775 - protein, 139 aa, Pseudomonas aeruginosa
AGDRRTAVRGYRWCVRCAGRSGWSWSRRCPLPPRSTGRCRHPAGCSAAHRSAPARRPRRRPPWRSGRPAPGPLREPRRSLSDRRPGVRPRARDCARRVPGPRSRWRLPPADRGCTGRPRSSAGFPVHPRKARPPSRWSW

SEQ ID NO: 32776 - protein, 243 aa, Pseudomonas aeruginosa
SPLTRRTGRSARWSAASPSSRATTTARSRPSASRAPVSSRSSTARPWTTASPPPAWSTMRRSCSSTSTWTRSGDRRTTPTPSSARSRCAKPCTSPATWSRSASCRAWASSGRSATSPSSASSATNCRATSPWPWVPRQSHRWKSPAPGAYSPTAATRSIRTSSNASRAATDRCCTRPIRPACRWKNRSLRRMRKTPGILVTPSIRRAPKAKVRSKPSKSPPRPRPPSSRPRPSGSSMPVPPIS

SEQ ID NO: 32777 - protein, 503 aa, Pseudomonas aeruginosa
PAVRPRRALPAPISRCSRTRTPRPRSTNCRQAASLAARCRMTKARRSTCSEPAPALRWRRREREAQAKRNPAKAGFLFIRRIDRSAVEDVVHRFQRIVLRIRQGSHAGLDGSLGHGIGDHGDQALVHRLRNDVLAAEFQLVHTIGGADVLRNRLLGQVAQGQGGGDLHLFVDARGTYVQGTTEDEGETEHVVDLVRIVGTTGSHDHVVTGGMGQFRLDLRVRVRAGEHDRVRRHALEVFRLQQVGAGQADEHVGALQGVGQGALVGLGGEHRLVLVQVVATGVDHALAVDHVDVLDLGAHAHQQLHAGDGGSAGAEADDLRFFQLLAGQFQRVEHARRGHDGGAVLVIVEHRDVALFDQRALDLETLGSLDVLEVDTAEGDGNTLDGIDESLRALGVDLDVEHVDAGEALEQHTLAFHHRLGGQRAEVTQAENRGAVGNHCHQVALAGVLVGQLGIAGDFTHRLGDTRAVGQGQVPGGSGGFGQLDTQFSPDGVVRDIRGQRF

SEQ ID NO: 32778 - protein, 739 aa, Pseudomonas aeruginosa
VSDLILRLALPSPLRRLFDYRAPRGIPRSALQPGIRLLLPFGRRELVGVLIEVTDRSEVPEDKLKPALRVLDAKPPMPAHLLELCRWTAQYYQHSLGDTLSWALPNLLRQGEPAEARQQRFWHATAQSSLDDPRLARAPRQRQALAILKQHPHGVSHELLNQLQINKDSLDLLKEKGLVQLEVRRHSTPPREGGWLAQAELPLNPEQRAAFEAVRASHGGFHCFLLAGVTGSGKTEVYLQLIRETLAAGRQALVLIPEINLGPQTLARFERRFNARIALLHSALTDRERLDAWLAARDGEADIVIGTRSALFTPLKRPGLIIVDEEHDASYKQQDGLRYHARDLALVRARLENVPILLGSATPALESLHNAQAGRYGLLRLTQRAGGAHPPKFIRLDVKSMPLDAGLSRPLQQAIGDTLAAGQQVLVFLNRRGFAPTLLCHDCGWISQCPRCDARMTVHQGSGELRCHHCDHRQRPPMNCPQCGKLDLRPVGAGTERAEERLRILFPNHPVLRIDRDSTSRKHAMRDLFATINSGEPCILVGTQMLAKGHHFPRVTLVAILDADGGLFSADFRASERMAQQIVQVAGRAGRAEEPGRVLIQTHLADHPLLVQLTEDGYFAFAEQALSERRAAGLPPFAHLALLRAEAHKPGQAEAFLDSACSAAEQLLEQMGGPEVELLGPVPAPMERRAGKHRAQLLLQCMSRAPLHRLLTPWLQSLEQLPGGRQVRWSLDIDPIDLF

SEQ ID NO: 32779 - protein, 645 aa, Pseudomonas aeruginosa
SPQRLATPVRPRIMRGSEPRPATPRTSRGVNFGAPHPPALPLPDRRAPPLCPRARRKTMKDTIRQLIQQALDQLTADGTLPAGLAPDIQVENTKDRSHGDFASNIAMMLAKPAGMKPRDLAARLVEAIPAHEQLAKVEIAGPGFLNFFQDHVWLAASLDRALADERLGVRKAGPAQRVVIDLSSPNLAKEMHVGHLRSTIIGDAVARVLEFLGDTVIRQNHVGDWGTQFGMLLAYLEEQPVDAEAELHDLEVFYRAAKKRFDESPEFADRARELVVKLQAGDPDCLRLWTRFNEISLSHCQKVYDRLGVKLSMADVMGESAYNDDLAQVVADLTAKGLLTEDNGALCVFLEEFKNAEGNPLPVIVQKAGGGYLYATTDLAAMRYRHNVLHADRVLYFVDQRQALHFQQVFEVARRAGFVPAGMELEHMGFGTMNGADGRPFKTRDGGTVKLIDLLEEAESRAYALVKERNEQRAERGEEPFDEVQLREIGRVVGIDSVKYADLSKHRTSDYSFNFELMLSFEGNTAPYLLYACTRVASVFRKLGQGREQLGGKIVLEQPQELALAAQLAQFGDLINNVALKGVPHLLCAYLYELAGLFSSFYEHCPILTAEDPAQKDSRLRLAALTGRTLEQGLELLGLKTLERM

SEQ ID NO: 32780 - protein, 284 aa, Pseudomonas aeruginosa
SNPPEQESGNPHGKEETRPQARRQPLPGARREERRSRLGLAGRRPGHRRLHHVPDEARTRAQGRPARTPGRPAPGRRRAGQAAAAERPGPAARANADAGPGQAEVRVLHPAAGVRGRGAAGSGTGEGPAAAHPRRTGQGRRSAGQGRTRRAGATAAAESGGRRQHAVLPAGRLVPQAVRRRPRARADHPARAVGERRGRQRPRRDLVPGDGRPVQQPRPVVPGAEDTVLQRLQQPAVTATQGPLNAGHAVRSDARRCVRLKSRGSPLYLPAFRAFGPAVWRFPP

SEQ ID NO: 32781 - protein, 466 aa, Pseudomonas aeruginosa
PSRSWTAPSEALVPRWSKRMSMTPREIVHELNRHIIGQDDAKRAVAIALRNRWRRMQLPAELRAEVTPKNILMIGPTGVGKTEIARRLARLANAPFIKVEATKFTEVGYVGRDVESIIRDLADAAVKMLREQEIQKVKYRAEDAAEERILDALLPAARPAMGFGDEPAREDSNTRQLFRKRLREGQLDDKEIDIEVADNPAGVEIMAPPGMEEMTNQLQNLFSGMSKGKKKTRKLKVAEALKLIRDEEAVRLVNEEELKARALEAVEQHGIVFIDEIDKIAKRANAGGADVSREGVQRDLLPLIEGCTVNTKLGMVKTDHILFIASGAFHLSKPSDLVPELQGRLPIRVELKALSPNDFERILTEPHASLTEQYRELLKTEGLAIEFAEDGIKRLAEIAWQVNEKTENIGARRLHTLLERLLEEVSFSAADLASEHSDKPILIDAGYVNSHLGELAEDEDLSRYIL

SEQ ID NO: 32782 - protein, 310 aa, Pseudomonas aeruginosa
RAGARRVHECTERHRRPARQGPADDGPQPGCPRPAPAAAQCAAPGRLRRPVGQGAAGRHPAPAEPTGRPLPGSILAPQSLLPAHPAGLPGVAEATARLDRRKQPGLRRSRPRPLPRRLALRRRGTQQQPDQSTGGKGTVQYRRDQPAQWRPPPARRPGAQRRHAQPGEQDRLRDRSQPRHHARRGGVPQRGAGADPVQAAGRAPVRQAPADRAAADQQVLHLRPVAGKELRPVRPEEQPAGLRHQLAQPRRPAPRMGPEHLCRGPRPGHRGQPRDHRQPQREPGRRLRRRAHRGRLARPPAGAPATAQGQ

SEQ ID NO: 32783 - protein, 363 aa, Pseudomonas aeruginosa
CWSPRICAARPNARRKAWRSATWDRNEKRPASAGRVPCRQDSALAARRRRSVRCRSAGSRCGGGGSGRARRRGGSGRFRRGGLGCRLLRRRLFRSRLGGRFRRGLGGGRSGRLGCGRFRSRLRRGLGCRLGRRFRCGLRSRFGGGLGCRLGGRGFRRGFFRRGFRRRLGGGLGCRFSCRLGRCGFRRGLGSRFRRRLGRCLRRRLDADAGEFLDLLGQRIDLAVQLLHLVAARHAETRDGAVQALVESFLELAPLAERTVPNLVDLALRRAGGSLRRTDLRVHIGLRFFFSLLAVFHQGLEQLAAVLADLRVGPQTSQPDLPRVFLDLADPTGLFFALLLASHPALLIGFSRHARALRSAHPA

SEQ ID NO: 32784 - protein, 621 aa, Pseudomonas aeruginosa
AEDGRRQDGERPAGSGQRLVQRLLDLALEQAAHGRQHQAELDVHRDLVRPHRDPAVDATAFEGQLVALPFALHAVLLRQTFGQFLRLGPCGVQPQAVRTFDVDTRHGSTPDCRSENYTRPDKTPHPRRRTAAQHFPHILLECPAFFPGENVMNDPRKGADAEPTTHFGYQNVPESQKAKKVAEVFHSVAAKYDLMNDLMSGGIHRLWKRFTIELSGVRSGNRVLDIAGGHRRPDPAVLAPGRPDRRGGAGRHQRLDAQGRPRQAARQGRLRQRQLRPGGRREAALPGQPLRLRDHRLRPAQRHPQGRSDPLHAARAQARWPPAGAGVLQAEQQPAVQGLRRLFVQPAAADGQAGHQRLRELSLPGRVDPHAPRPGNPEGDDGGSRLRPRDLPQHDRRHRRPAPRYQALTEGAPMSSLLIQAVLATAETGINRVLRLDGTALPRLRRLSAKVIEVDCLSPPLRIFILPAGDGLHFAAQHEAEVDCTLRAPAGNLLHLALARDKTRVLHSPEVSMDGDSAALLELAGILQSLELDWEYELSRWLGPLATQVLGSGLRDASRWSAQSLHSLRLNLADYLAEESRTLVGQHEAEARFAELDQLKLALDRLDARVGRLSQKTKPDA

SEQ ID NO: 32785 - protein, 166 aa, Pseudomonas aeruginosa
ARADSQSRSRLAHYSHFRRKRAQRTGNERGKTMKDWLDEIHWNADGLVPAIAQDHETGRVLMMAWMNREALALTASENRAIYWSRSRGKLWRKGEESGHVQKLHELRLDCDADVVILMVEQVGGIACHTGRESCFYRVFENGAWKTVDPVLKDPDAIYEHAGHHHE

SEQ ID NO: 32786 - protein, 200 aa, Pseudomonas aeruginosa
HPDPPGGGARGAQERRARQLLRGQSVPQGPEQDPGEGRRGVGGNHHRRQGCRSQRRLPGPDLRNRRPLVPLAGDALGPRPASASRAGRTGAPLRPFPATPRKPPANHRPEPTHCEEYDMGIFDWKHWIVILIVVVLVFGTKRLKNLGSDVGEAIKGFRKAVNTEEDDKKDQPAAQPAQPLNQPHTIDAQAQKVEEPARKD

SEQ ID NO: 32787 - protein, 199 aa, Pseudomonas aeruginosa
SMSADKPEQPEHDQEMPLVSHLTELRTRLLRSVAAIFLIFAGLFYFSQKIYTLVSEPLRRFLPEGTSMIATDVASPFLAPFKLTMVVALFLAMPVILAQVWGFIAPGLYKHEKRVALPLLVSSIILFYAGMAFAYFLVFPMIFHFFASVTPEGVAMMTDINSYLDFVLTLFFAFGVAFEIPVATVLLIWIGVVDVEYLK

SEQ ID NO: 32788 - protein, 68 aa, Pseudomonas aeruginosa
IRPYVIIGCFVVGMVLTPPDIFSQTMLAVPMWLLFEIGLLFGRLVRKRGEHPDDQPASDGDQPPATRQ

SEQ ID NO: 32789 - protein, 710 aa, Pseudomonas aeruginosa
RFSPPGRHPLSRRAPHDNHKTSPAGHVPALRARTPDATTLSHYLFRHAMGLPTQGVALPGVMTMYDWWVLQLAKLSVSRKLMVGFGVLLALLLLVVISSNRTLTHQTALSEQLAEVASLMEQTQQAEQGRLAFEAGSDPRQAEQVRQTLAGMLQRLQALRDSELDPAALAHQTEAIEAYRKAFDDLAAADQQRSAARGVLVGTAQQALDSFARLEELMDASLAQQAGDPQALQRSRAVADLHQQLLMVRYQVRGYVFERSDKAEQAAFAAFDALRQAATTLRGQLPGEADAALEQAMGSLQGYRGGIEQFRAGVIRTRQAQQAMQSSTQDMARAGRTLTEAGRQLRESTASRDRASLWLIAALALAFGCVAGWAINRQIVRPLDEALAQAEAIAAGDLGKRPQNPLTLQRRDELGQLQRVMQRMGDSLRELVGRIGDGVSQLASSAEELSAVTEQTRAGVNSQKVETDQVATAMHEMAATVQDVARNAELASQAARQADEEARQGDAVVDQAVTRIERLASEMDVSSEAMARLKNESEQIGSVLDVIKSVAEQTNLLALNAAIEAARAGDAGRGFAVVADEVRGLAQRTQQSTAEIEGLIQRLQQGAGEAAERLENSRSLTASTVELARRAGAALDSITRTVSDIQNMNLQIATAAEQQSTVAEEINRSVLSVRDVAEQSAAASEQTAASSGELARLGTQLQAQVGRFRL

SEQ ID NO: 32790 - protein, 165 aa, Pseudomonas aeruginosa
RTWRRKAWARGSCGLSKNCAGGASSSSLPWSKNSTRSATSRAKPISWVTQTMVMPSTARVFMTSRTSPTISGSSAEVGSSNSITLGSMHNARAIATRCCWPPDRREGYSSAFCPMPTLASSARALASRSALPRLRTTRWARQRFSSTVMCGNRLKCWNTMPTSRR

SEQ ID NO: 32791 - protein, 268 aa, Pseudomonas aeruginosa
ALMSVLGSARSTPSMLTEPSSNSSRPFRQRRKVDLPEPDGPITTSTSPLATRVLTSSTARTTWPRVSKTFSRLRTSITLSEPPLQSGCHVRKGQVQQQVQRGDAEPDLEGGERGGDRLAAALGQFGDGDHRDQRGVLDQADELPGQRRQHALEGLRQDHVAHRLAGVQAQGAGGLVLSAGDGLHAGPDDLGHVGAGEQRQRRNPGELAGQVEHGADEEVEDEDLHQQRRAAHQLDVDRRQAVQGRVLRQPAEAGDQADSQTDGTGHQR

SEQ ID NO: 32792 - protein, 214 aa, Pseudomonas aeruginosa
VYSSVARSSRGVSYSSGIRNSFSSRARRPSFTRLEITDTGIDRISEPTIGDSHHRKRGLSQATSRVQAIPSRVCMPCRRIASLQGVASSSRCGEFHCTDQPRKAASTKRVWKSMRTGASSTEKNISRSMLRVTRITPPKPLAPLAQISITLSSLGRNNRVRVVENNAMAFSGCHCGQIGNSCRGSRKYCGSISWCTASSAVESTRKKNHNGADR

SEQ ID NO: 32793 - protein, 529 aa, Pseudomonas aeruginosa
SASGAFVVDGLFIGRQLIAPGFAQWLLRLVDQRRAHFHRFLRILDLDPQRQAPAFQDRVVTQAVLHHLGVAVGADLGGHRRVRRQVLQGRPFEVDDQGGAAVLLADQVLLLHVADRAHGLLDPGGFRVVQLVFIHGPVQAVGEVQRLSDLRLGLGVPERDDIVVGFVRGRDFHQFHGALAPVALRLDPGTRTQVVAVIQVFVAGELAAALEQAEAFRVLHAEGAHRQVLRIVQRTPQPLAVAGMDLQAAGVMQLGPEVVLLGRLVGAEQVHAGQRRQAQLADLVAEEHAGLDIHHRILARTQHEAVGAGGPRRVEQGVDHQLLVLRLRPLDPEFAEARELFARRQRGIDRQAARRQTVDLALADHAEVARAKEGGDLVLLVGLVDRIEHAETGIAEILGGILVELQGSEIELGAIVLDRLDRGSGHLVDLHRRVEVHALVIEAQLERRLQLAPVGALVDETDLLVIGEFHFAEFRWQVAGRRGILVAGQVLGLARHVVDAERPYRGGDECQRGRAGKQQGAHAGAEIGV

SEQ ID NO: 32794 - protein, 235 aa, Pseudomonas aeruginosa
QKAMYLSQKFTVPAPPSLPEAPWGKSPRRRSTLQQEGHRPVVDQVHLHVGAETPGRHLRIGLPRQFHQVLEHRLSLRRRRRAGEARTQSAAGVRRQGELRDQQQAALHVQQGPVHLALVVAEHPVVEQLVQHLRRATLAILGLDPDQHQQAAIDGADDFAANLHPRRADALQQCLHSASGGRSSSRRPISLVARTSASTIPGSLAVCPASRMICSSLFGQAWCRAQALSSGQMAS

SEQ ID NO: 32795 - protein, 228 aa, Pseudomonas aeruginosa
GLISGYRTSMMRSRGDVFGPRRKRRQRGPSFALPRMILRRREKNRAAFMSAPVEGKPSIQATAPGAGRTSMAEALRHRIRAAGLLVVEQRILLVRHEVGGDIYWIPPGGGFESECDESTKDTVRREFFEETGLRVDVGPLVYVREFAEPAAGRFHMELFYRIDAWRGEPTLANLKGLGGDEFDIREVGWIARDELPGLPSFYPAELADDVWSRLDAPTPSIRHLGLQR

SEQ ID NO: 32796 - protein, 192 aa, Pseudomonas aeruginosa
SASMRSPPTSTPRTAAPPSTIFVTLRPCSCRQCPEACKRSASCTQKAWQSATSSSGVWMPPTKGAADRAGSSARHSAAVRTNCAEGSARPWRARAKLAGWRNATSLPLRRQSKPSRPSSSRQSCRVRWLSNARRSRCAALRRFSEPRQAARKPSSQRHCAGSRRGRRRNGASLRSSQPSAWAGTPLSANGAT

SEQ ID NO: 32797 - protein, 341 aa, Pseudomonas aeruginosa
AMTIVIQVFSRTSTIGADDSGRTMNKDGQGINPGYGIAPMKLRHIEVFQAIRQAGSVSGAAQLLHVSQPAVSKVLQHAEQQLGFPLFLRVRGKLLATPEALELEREVAKLSDSLQAVRRLAQNLRRQPGHSLRIGATPALALSLLPRAIGEWSARYPQSGCELATLHSRELVQGLLMRELDLALSLKQPEHPGLRGEAIASGVLVALAPREHWPEAERRQPLSLAGLAGEALIGLSTADPLFARLEDYLSAVEPPPQVKIAVQTYALARALVEAGAGLALVDPFTALGADPHSTAIRPLSPAFPVTLYAITRADETPPHTLAPLLRMLARQAEERLRAVQM

SEQ ID NO: 32798 - protein, 517 aa, Pseudomonas aeruginosa
VFPDLLQLLPLFPQVMRQVALYLRHQLLLAQAFHHVVGGLRGVAGVGGVGHDEQVQVAGHAPGLAHLRSLPQALGEAGITEVLVFHVDVVGGIAQGLEIVLQDRALVVLRLGPANLRDAVAGGRGDLRQRQGVALGGQRWRREPALVPRRLEVPGLAEVAAEVGQHRSLDLHGDILPGPEPGIATGGAVVEQVGAGVPVVAVHVVTHDEADGLRAAIVDQDHLLVMAGELGEYQQLADAQVVDAIGAQQVDQALQSPIDEAHLLAVHHRSGRLLEVAGTELDVLQPTAAYRLEPVAGEYLPPGILAGAAGTALAAVALGLAAVESALDLGVLRLQLGDARPRVGGAPRVEARQPAFAVQPFRALQGFLLPRDEVEVMLAPLLQSQHLVVHRAAAGDARARPGAAGTADAGPGDGVFLEPGELVAPDQHSRLHSFAALRLQQFADSRSVGAFETHGRVEAPGDDVDAVPGRLHRRMHRVEGRLAIDQRLDVHTRARRVESLVGEPVEGQPDAAGLLRV

SEQ ID NO: 32799 - protein, 210 aa, Pseudomonas aeruginosa
SRGMCQSVSVSARASSTRPASTAGVRRVPGCGMLISSGTRPRLKLRTSSTVYLLGVANDAFRQIAAQPVGQLRRTLDVPGDEVGQLADLQAAVTGFQPQRPGGVQGDTGQRLLRGQAEQGTGHVQHQAQRQRRRGAGIEIAGNGHGHAVPAQGIDRRQLGLAQQVEGARQQHRDGARLAHGAGVVLGHVLQVVGRQSPVARRQAGTVQRG

SEQ ID NO: 32800 - protein, 336 aa, Pseudomonas aeruginosa
HLALAGQVEAVAGLDLQRRHAVAQQGLQALARAGQQFFLAGLAGGAYGAGDAAAGGGDLGVADALQALLEFAAAVAAEHRVGVAVDKPRGQPGAIEVDAFGVVVGRQFGARADPVDQRTVGDQGGVLDDRVLAALEGGGMAMLPESFHCRSPMLAASRARLFRSPRMAAALAMSGASQRSVSYAGTRSRRMPQAAAVPWPKRCGARNSKAWAASRYSMARIRRRFSRALPSLSAALVPRLRWSSWSAEVTKLSTTAGCASWRFSPAREAATYWVIIIPELTPGLPTRNAGRPLTSGLTRRSRRRSATPPSSATAIASRSAAIATDSPWGLAWDTTR

SEQ ID NO: 32801 - protein, 156 aa, Pseudomonas aeruginosa
ASGVPSSSGLSVAELSSVSICRAAWANWSRQAPWICGIERMLRASWVRMPRAFSSTWLPASKARRLTATRCIPGCGLSATISASNAASWPRRASKLIAPITSAHCARRCASSRARQARPVMHGVPLTRQSPSLAPRRTVARPSAANAAAAGTTLPR

SEQ ID NO: 32802 - protein, 995 aa, Pseudomonas aeruginosa
TRSSLRSCSSAHRSFARLVPGTAIGLGDAVDHHREDDDRQAGFQALAHVQRLDAHQYVFAEAAGADHRSDHHHRQGHHGGLVDPRHDARQGQRQLHAEQLLPAVGAEGVDRLHHLAVDLADAQVGEADQRRRGIDHGGEDRRHLAQAEQHQHRDQVHEAGHGLHDVQQRHQHRAQAVAARGEDAQGDADQHRDEGRHQHQREGLHQLVPEADGADQEQQAGDHQGRQQAPGGVPGDRRDDRQQQPPGRGAEQPFEVDDGPQQGVGDLAEQVAVVGHQGVDPSVDPVGDGKCQAFGKHGLLSSVVGSECRFDLLRRVLVDPGVPDLGVLLEELARQARRIDPVLGHPRQVAVQQLRRQVDLLQHRHQLRRLVVEGPRQADLDPDALVDAGPFLQAHQVGAAHQRRRRPVVEQDRLAAPIARQHRRVQCRAGARTEIGERLLQAVAFQHLAVLQLAGPAGRAIVEAPLARLFRVAEDLGVLRQVGDRAQLRRLRLELALRVALDHVARHVPALHRADDGFADADHLAGRGSLVPGVAAADPLLGEDLDVIGAQRLLHGDRVARQAVGGTAVALGQDELHQFGEQGPALPVQPGELHRLAGLAPAFRLGARRGGEQAEGTENTQHRLLVSHGSTLQMHDWERQLENLRAAPGGTASIVVIGRRPRPPSVPSQPSLGLKHAMRGIALRPDPAPVGDHQQGDPDSPDPQGRAGVREIAEHHEDEQHEDDRRRRREWPQRHRELQRGDLARPYAPAHADLGQEDHQPDPHGGEGGDGRDQQEYALRDQVVQRHAEQQGHRHQQHGHPRHAVPRHPREADRRLALAGHAVEHATGAEDVAVDRRNRRGDHHDIEDRRGRLDPQAVEDLHEGTAVAADLLPGEDRHQHEQGQHVEQPDAQRHRIDRPRDHPLRVLRLAGGDAEDLDAAEGEYHQRQGGDQPGPSRWAGTRRAAKGCARRWRESPPPPKLKPKNKMPSPGRIIAKMAPTLTSDSQNSSSPKTLT

SEQ ID NO: 32803 - protein, 265 aa, Pseudomonas aeruginosa
RAFSPRRSPVSCVIPRLSSCCSCWSAPAERPGAGIKDSATAGPAAARSGNRWRATGWRPRYQGRRSDPPGSTAPCRAAGGEPAPASANSSGPRGSPGPGRRPATPRRESRGTFSAIAQSRLPAFGAIDTWSSWLAEVGRLSTLAGWARALLSLASAAAVTWAIMKPELTPPLATRNGGNCDMCMSIISEMRRSDSEPISANARARLSAAIATGSAWKLPPEITSPSAANTSGLSDTALASISSTSAAWRIWVRQAPITCGWQRSE

SEQ ID NO: 32804 - protein, 89 aa, Pseudomonas aeruginosa
PCPGVRRGEPVPEGSRRHCPAGRWRWPCLRRCSAGSAPGRRPGPWPARRRSDCAGGSRCGSAGTRCSANRRRPGSPPAAGRRPCRQGRR

SEQ ID NO: 32805 - protein, 425 aa, Pseudomonas aeruginosa
REANGTSPASTGQPQRSYWLASSAQPPYRQADQQPGRPFAARLEGILEPPHQGALTPAQVVRHEGWRGLLQGGIEARGDFGRHPVAPDFAMLAKKLRTHLADLAMILRHVGEQLVEQRQGDLDLAEQLDQRRRLVMEIAGNANGDLRRQRAGTDGVGVLRIGQGGPGLLAERRLFQLHQLETAHQRSRRPIVEKHRLTAPEGRTDRRIQRRAGAGAEVRVAVLQPVGLELLAVDDLAGPAGRAVVETPLGGLLGIAEQRLVARQVGDRPQLRRLRLDASLRVALDQVLRHPPALGGALHRLADGEHLARLLRRAPHRATPGPLLPGDLDIVLAQGVFHGHGIARQRVGLAAVAFFQYVAQQVGGEHAAFPVQPGEHHFARVRAFRRDGGLAGEAGAQGEDGEDLAKRGHAGLPVGVGRHAELYRH

SEQ ID NO: 32806 - protein, 475 aa, Pseudomonas aeruginosa
VYAPLNRLYMYIQIKQTACELIMSAIFAERALLPEGWARNVRFEISADGVLAGIRPDANADGAERLGGAVLPGMPNLHSHAFQRAMAGLAEVAGNPNDSFWTWRELMYRMVARLSPEQIEVIACQLYIEMLKAGYTAVAEFHYVHHDLDGRPYADPAELSLRISRAASAAGIGLTLLPVLYSHAGFGGQPASEGQRRFINGSEAYLELLQRLRAPLEAAGHSLGLCFHSLRAVTPQQIATVLAAGHDDLPVHIHIAEQQKEVDDCQAWSGRRPLQWLYENVAVDQRWCLVHATHADPAEVAAMARSGAVAGLCLSTEANLGDGIFPATDFLAQGGRLGIGSDSHVSLSVVEELRWLEYGQRLRDRKRNRLYRDDQPMIGRTLYDAALAGGAQALGQPIGSLAVGRRADLLVLDGNDPYLASAEGDALLNRWLFAGGDRQVRDVMVAGRWVVRDGRHAGEERSARAFVQVLGELLD

SEQ ID NO: 32807 - protein, 288 aa, Pseudomonas aeruginosa
AGWRSRTSRAATAPPAQRRAADTPAGSRAAARAGSARQPPAAGRRSGPTPSPANARRCTVRRAGRTGSAAPAPAPLATASNRAHGQRSGPSPAATGQGVAATASAWRTAAARPASRIRRTAGNRNARHWPGPTAPPGPAPGTAGPVRASARAAPAASTTPLSPRPPVATHARAGHKARSGRFRTARSAPTSRLPRAAASATARPGRGYRYPAPARARRRGAAARRRPAPPGPALPASRTRNGPGAAGLRRSASRTATARRGGTPGRPLPARRGRSRSSGAGAAPGSAR

SEQ ID NO: 32808 - protein, 248 aa, Pseudomonas aeruginosa
RSMGWTGSGGQGGGGAASTAGSSMSQSSGGATSAGGAGGVSASGWSIPAAGSGTLSGRSCAWRSTRSKRWWMTSVPRSKRSANSLICLRRRSFCCARFCSETACPRARPERPPRRAPTSDSPAKPPRIRPTSMKIHCMRRILDQEVPRSTDTCPGHPARAEPAPGVYSPHSRDSTHSDARPVASYLFLAMNWTTQAAPVWKRPSTTSRSISRASSTSHSGSSASSAARLTSMSTSAGPPVPRPSCSGR

SEQ ID NO: 32809 - protein, 784 aa, Pseudomonas aeruginosa
GQGHAATGHRRGRATIRGTGLDPALLRGKGTDRLQRPARPAPAVRCRRAGAAGADRAGPRRRVVAGRDCRHGRSRRRAADRPRGAGGQGRRTGPDDPPPRRHARRPAACRGLSGARAHGLPDVPPLAAGRCRGGHQATPESARRIAKRPAGRAPLPCLPAARHAVAARRYGNGLDLAALVALAVVLVEHLLAQADRLRRHFHQLVVGDELQRLLEGEADRRNQGDDFVLAGSAHVVELLALGRVDHQVVVTAVDAGQLAFVDFVARAEEQLAAALQGLQRVGQGGAGGHGDQYAVLAVADFAGLDRTVVAEGRGQDAGARGQGQEVVAEADQAARRNGVLQAHAALAVGNHVAQVALAQAHLLHHRALVLLLDVDGDVLVGLLLLAVLLDDHHFRAAHGQLEAFAAHGLDQYRQVQFATAGNLELLRAVARLDAQRHVMQQFLLQALLDVAAGDELAFAAGERRIVDLEGHAHGRLVDGQRRQRLDVLRVAQGIGDEQLLHAADADDVAGFRLGHLDALQAVVAHDLQDAAVALAAVVADGHHRGVGLDLAAGDAADTDHAEEAVVVQLRDLHLERTLGVHHRSRDVVDDRLEQRVHVVVHLLVVEAGDAVQGAGVDDREVELLVGGAEVVEQVEDLVDDPVRTRARAVDLVHHHDRTQAGLEGLLGHEAGLRHGAVLGVDHQQHGVDHRHHALHLAAEVGVTGGVDDVDVVAVPLDRGVLRQDGDATLFFLVVGVHHPLAFRFFAVEGAGQLQQLVHQGGLAMVDVGDDGDVAQIFDHKSCLV

SEQ ID NO: 32810 - protein, 527 aa, Pseudomonas aeruginosa
AADVSGGRWRMLPPNKPGCLSRTINTHIGVPLVEQVMGMQAAHHPFVAIQEVLAVGVQFLEAAVDRVERQRLDFDAFQGQGFVFLGIRMADIDDNLTGQHLADLFHLQVLAEFVDHPVDGALGGALQGALEHRHVEFRLFVLDAVGLGLGGRVHRDHPAVFRHVPGELGGADLPGGVDDVLLVADDQRTQHQGVGNPVDHREVRQGLAGHLGDRLAGHQRVQLQALGHAAGGAQHHALEGHAHIAVVDLGEDLADHFLERHADEQHALRAAVLLPQVVGDFHHPQFVGAPAEVEEHEVADHPAAHHLVGRHGRVEAAGHQHQHLFQRAQRIAAQARMLAMDDEQAVEADFHPHLDFRLLQVDPGSPAFAAQAAADVTLHLHRGERVLAGALAAHGEGLAGQLVAEMRLALGEDVVEIAQRILVDLEEMTDARGAGQALDHLAPGLGVDHGGLYLQVVPLALDLQLRVQVAQHRADVLRQLPDEALAHRPALDGDFLEGLDDEFHARDANARGDGKKGAELYLKLLTY

SEQ ID NO: 32811 - protein, 481 aa, Pseudomonas aeruginosa
SLLEDSMSYKSHQLIKDHDVKWVDLRFTDTKGKQQHVTMPARDALDDEFFEAGKMFDGSSIAGWKGIEASDMILMPDDSTAVLDPFTEEPTLILVCDIIEPSTMQGYERDPRNIAKRAEEYLKSTGIGDTVFVGPEPEFFIFDEVKFKSDISGSMFKIFSEQASWNTDADIESGNKGHRPGVKGGYFPVPPVDHDHEIRTAMCNALEEMGLVVEVHHHEVATAGQNEIGVKFNTLVAKADEVQTLKYCVHNVADAYGKTVTFMPKPLYGDNGSGMHVHMSISKDGKNTFAGEGYAGLSETALYFIGGIIKHGKALNGFTNPSTNSYKRLVPGFEAPVMLAYSARNRSASIRIPYVSSPKARRIEARFPDPAANPYLAFAALLMAGLDGIQNKIHPGDAADKNLYDLPPEEAKEIPQVCGSLKEALEELDKGRAFLTKGGVFTDEFIDAYIELKSEEEIKVRTFVHPAGIRPVLQRLIHPFL

SEQ ID NO: 32812 - protein, 457 aa, Pseudomonas aeruginosa
  UNSURE (451): Identity of amino acid at the above locations are unknown.
QRVTLLRPPSGGLFYGPAHGETQSSPRRSVRLAALPAPRIRTVHASLSLAPACRHPQPARPGRHRMPRYPRPRPAAHVQRTGTRRQRGLRRHRQPRPAALLRRTAGAGTALRLRRHPRRRHAPPVPRHRPRRPQALRRHRQPRHAPPVPGRGIACAVAVRRHRRPRHAPHLPGHPVALDAAVRRRARLVRFRGFRLGRPAQLYVETRHGQFEAGLVEAPTQAQVERPLDLPLLDRRGLEAEAQDRLAVVETLHALQFHRRPQVAVDRRVAAQLHRDLAHQRHRVVDRHARRHRPAEHRVAELARVVLDALDLAERDGMHHAVQVAQAHGTDSQALDRAKVAADVDVVVDRQRVLDDDEQAGDQVRHQRLRAEADGQADHAGTGQQRGDVHAHVGQGDDQGEKRDFAEWQAVFAALDACVEPLLPLSEALEHPQLQARGLVARVPLADGGSXAQMACP

SEQ ID NO: 32813 - protein, 427 aa, Pseudomonas aeruginosa
  UNSURE (7): Identity of amino acid at the above locations are unknown.
SDRPSAXGCRRPPAAPGRPARAPATAGVPAPRRAAAAAPRRHPGRRTPPAIRRSRVSRPDRRPGQHGHERHPVAGRCRRDRPGHRLRRAVAGGGPDHRPVHHHRGLAVDRRLRRRRRPPWHGRGPDYPYRAPARPGRRGAYHPVQRDQEHQELLAPVRLRDVPLAGAGEHADRRRGGAGARGRDGAAQRPGGLPQPVVADGIAGRGEFRQRPGDPALPLQDRADQAVGGPAGVQLAPASAPRPGRPRTVHAASQRTVEPGAQGEIRGTGRAGHAGGRRHLARQDDPADAAHVAVVDAVALPRRTRYHGPALAAHVAAVDVVAALAVAADDGAALAARVAVADVVAVVALSRRQQCAAVTPQVAAVDVAAIPAVAAFQCVAHAPQVAVVDIAAFGAGLGGQAEDGGKQEPERVTHGRSLSLGRGARQV

SEQ ID NO: 32814 - protein, 437 aa, Pseudomonas aeruginosa
AISDIIPPLFFRRPARSRPSHETHRQDLPGNHHQEPAGAQALHPAVGEEHPRGAARPGPGAEGRGRVGQPGGRDRRGRRQGQARDDRAPDLHPGHRSFPRGPRVSAGRFRRHPRQVQGAFRRPVGRQDLRRALQARRQARVHLDGGGALRRQRPAPRMRGCRDRPEAAGSRGADGNPPRPPVRHPSPASGPGRLSAGRAGTGAGADVRRLRLDRGGLPDDAPRDDQPLRVLQPRRARPRTGGDGSRPLPVGEVRPLAARAVRQRAVRGSGRRDPHQGRRQLYGRDPQAHDAARRQPRGRAPGAGRAGDRRGDLPGVQPDPAEPLGDRPGYRHPGAASADRQPQAGHHRHRPADRHRRVRPAHAGILRGDLGEPDHPGQALPRRARRVEIRHGGARARPGARHPAHRRPGDRRTRPGPAGGRGRRGAARSDCHRYPPS

SEQ ID NO: 32815 - protein, 369 aa, Pseudomonas aeruginosa
RSLSCRAPPCPTPPPPRSRASGVKRDKTCDRKSAQHRHHRPRRPWQDHPGGQAAEAVRHPRPQRSGKRAGDGLQRPGKRAWHHHPGEEHRDQVERLQHQHRRHPRSRRLRRRGGARDVDGRLRAAGGRRPGRPHAADPLRDPEGLQGRPASDRGGEQDRPPGRASGLGHRPDLRPVRQPRRHRRATRLPDRLRQRPERHRRPRPREDGRQHGRAVPGDHRPRPGSGGGHRGSVPDADLAAGLQQLPRRDRYRPHHPRQGQVQHPGGGHQRRRQQAQRPHPEDHGPPRPAARRGGRGGSRRHRLRQRHGGAVHLRYPVRPAERRGAAAADRRPADREHDLPGQRFAVRRPRRQVRHQPQHQGAPGEGTAA

SEQ ID NO: 32816 - protein, 647 aa, Pseudomonas aeruginosa
CSVQRRCSASGSCVARRRKRWPTGSRPAGRCWRPPAWPSSTWSHRSAWPSTAPPSPGPWPGLASLFAGLRLGSRTFLFCAFAVQLLGGALFLLHLQGGDGQGGVFDSGWRGLMTASLIGLALIGGMLLAARDPLVKDDSRLLMGLSLVLLAGLAFVNLAVLFVLPWRSASAVWAGSGLLIIWLSLVLRQRLSFYFGLALQVVGGLAFLLAGPSLFGSLSGEGLRPLAHSGFWTPAVLALAALVGAWRLRRAGERERALGIGTLGLAELSHLLLLWGAGWWALTALCETVRFVPYGLREHALLLVAAATVASWMLLALRERWRELALLCLALVPVALLALASAWRFDYQPFGEFGWLAWPLLFATHLLSLRRLAPLLPAKALSVAHVLGCWLLLGVLALELRYLFALLAEQYNAWRWLGWALVPSAYLLLVAGGRSLPWPLRDFPREYRLLAAAPVALLLLGWFWSANLLSDGAAEPLPYLPLANPLELGLLIVLFALYRWSDASLASLVDGNASARLGRQALAGASLFALLTLAVCRAAHHLAGVPFQAEALAASMLVQAGLSLVWTLCALGLTIAGTRLGRRDLWMVGAALVGVVVVKLFFVELGNSGSLERIISFIGVGVLLLVVGYFSPLPPRRAEVASEAEQP

SEQ ID NO: 32817 - protein, 123 aa, Pseudomonas aeruginosa
RPACWLRCPPPRRLLLRLIRRWWCSATASAMPGSSPILPAPPEAPRVSPTGSARPTRTAAARSSDRPRPWGSAISSASPPGDLGASTSPVNGPAGHRPTATTGRWAATGPTRSTTRSPRPTAR

SEQ ID NO: 32818 - protein, 173 aa, Pseudomonas aeruginosa
SASSPWAAASAARKATPTATCGRSARAWATTSPSRPTVPGTCRRSSAPTMHGSRSTAIPRRAPAPPRSTTTTRSAARSAWAPACKASTRSAAILSCSPSTPTNASTRTTPRTSPCPSTACRAIALPSKATPRRTTSTASPSASARSWHRSCRCAAATTGARARTIPSRASAWR

SEQ ID NO: 32819 - protein, 390 aa, Pseudomonas aeruginosa
TARWGAADDRRSVARRGNEPRRRRRSPTGGCAESSVTANSALNCAGFFLSPEPSMSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPNEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 32820 - protein, 284 aa, Pseudomonas aeruginosa
GSASPEQGVPHGVVPYPGRGRFLRRPGRLQQDQPGKLFQAQGRHEQGRGRGDPRQAHRVLRRAGHVQLHLGRREGFHQRAVRGRQGAALLRPGAQVIGLPIRVLCTLWLGLLLVGCAGSPKNPPATEQVDLQRYQGTWYELARLPMFFQRNCAQSEAHYRLQEDQSIQVINRCLTLDGDWEQVEGRAVAQQPGRTDKLWVRFDNWFANLFPNVARGDYWVLAVDDDYRTALVGNPNREYLWLLSRTPQVSQQTRERLLEEARSRGYAVDELIWRVPDGQLKRSQ

SEQ ID NO: 32821 - protein, 147 aa, Pseudomonas aeruginosa
ARRGCPSRCPGARPGRGSPSPGICRRRGWPRCSGTGRPPRRYAPSPPPRRGRRGSHGPGTSAGRPRRSRTAIATAGVRSRPGSRRLPSAVRRYGCGPAGRRGRRRGPWRSAAESPRAGSGSTGPGSGLPPPAARAGAGAVPGRPRCH

SEQ ID NO: 32822 - protein, 592 aa, Pseudomonas aeruginosa
MCSVDPARPLLRPRIQAHPRRSPPVERHAQEPAVTTPSKFRDIEIRAPRGTTLTAKSWLTEAPLRMLMNNLDPEVAENPRELVVYGGIGRAARNWECYDRIVETLKQLNDDETLLVQSGKPVGVFKTHANAPRVLIANSNLVPHWATWEHFNELDAKGLAMYGQMTAGSWIYIGSQGIVQGTYETFVEAGRQHYDGNLKGRWVLTAGLGGMGGAQPLAATLAGACSLNIECQQSRIDFRLRSRYVDEQAKDLDDALARIQRYTAEGKAISIALLGNAAEILPELVRRGVRPDMVTDQTSAHDPLNGYLPAGWSWEEYRDRAQTDPAAVVKAAKQSMAVHVRAMLAFQQQGVPTFDYGNNIRQMAKEEGVANAFDFPGFVPAYIRPLFCRGIGPFRWAALSGDPQDIYKTDAKVKQLIPDDAHLHRWLDMARERISFQGLPARICWVGLGLRAKLGLAFNEMVRSGELSAPIVIGRDHLDSGSVASPNRETEAMQDGSDAVSDWPLLNALLNTASGATWVSLHHGGGVGMGFSQHSGMVIVCDGSDEAAERIARVLTNDPGTGVMRHADAGYQVAIDCAKEQGLNLPMITAQR

SEQ ID NO: 32823 - protein, 104 aa, Pseudomonas aeruginosa
PWRRRKAWPCSMAPRCPPPTRCAGCSRPRTCSPPPPSAAGSASRPCSVRGRRSMRASMPRAASVGRSTWPRPIATCSPPAARWRAPMRSATRSRTPIRCVASRR

SEQ ID NO: 32824 - protein, 127 aa, Pseudomonas aeruginosa
SPRSPPPRWPATTRPWPIRPASTACRPRPTRKTMCRWRRTPANGSGRWPRTSRGILAVEWLGACQGLDFREGLKSSPKLEQARRLLRDKVPYYQEDRFFAPDIEAASQLLASGCLNALLPARLLPSL

SEQ ID NO: 32825 - protein, 316 aa, Pseudomonas aeruginosa
FSPGSASCSSASAWAAAATPATGVHNLWQHGGFLPNGWARAGRLPVAGGIRLRRHRDLRHHRRRGAGPAAGDPAGDQCGAAAHPAVLRADPVRADGDLPLAADRQQRQSLRADLRRPGDRVGRGDPQCRGDHRGDFGDQQRHLRRRSHALRHGPPGPGAGRLLAGVAARRAVDDRAADGGGPAARRGAELPDPAERIPVDRVHRHLRHRVGLADDPPGPGRHAPAHRAAPGRRAEVPGAAVAIRAGDGDRLHAVHLRGARLFPGHPPGPVGRGYLDRLAGDRLPALGQAEGRCRAWRASGPGRAVTEPTAAWAAGQ

SEQ ID NO: 32826 - protein, 808 aa, Pseudomonas aeruginosa
HPGLRRGVDRPQRRLEQGCRGRQGGRRRRTHRRRGGGLVRAALRDRGRPAAQARGEGAEAALYRRPGAVRRGLPRPGRAGQGALLQLPGRLDLRAGEQRDAEKLRPGGDVHQFPSGHRPGTGRGGAVELSARRAYPVLLLVADAADGPRRPGAPGGKARRRQAHQDPGRPVADLPRPGAGAGGGAGEGQPAGGAAEQRPGADGQGPDRCGAPGARVPQGAPRGLARLGRRGRGEEDRSGTLNPRPTRADHVSRTPDIFHRRLGQRLGRRPGDQLRRPVPQDLRHPAVGHRQPRRAAPRHALVAVAGDRRGDRLARHPAPAADPGDHRPAVPGRRRRPLGQADADPRADAGGDLHLGADRHPPGHPRRAQQPPARGADAAAGHHADHAQLRVPDPGADVVRPGQGAGDLRHRDLCRAAADPPHRPGHPPGRQRGDGGGQRLRRQPLAAAVRRAVAAGPAEHHGGDQPDHHDGPVDGGDRFDDRRPRPRRRRTGGHPDAERGQGPGSRPGDRHPRGGDRPHHPGLWPFPARDEQMSGAQMNKIEVKNVFKIFGPRADAALALIRQGRSKGEVLAQTGCVVGVNDLSLTIGAGEIFVIMGLSGSGKSTLVRHFNRLIDPTSGEILVDGEDILRYDMEALRQFRRRKISMVFQSFGLLPHKSVLDNVAYGLKVRGESRAQCHERALHWIATVGLKGYEKSYPHQLSGGMRQRVGLARALAADTEIILMDEAFSALDPLIRADMQDQLLELQKTLHKTIVFITHDLDEAVRIGNRIAILKDGQLIQVGTPREILHQPADDYVDRFVQRRVANL

SEQ ID NO: 32827 - protein, 145 aa, Pseudomonas aeruginosa
ATYRASCSATVRCVGRNWSRWPGTVRAWNCRRRPGHGSTTPAPSSAVSSPTASVPTASVPASARCATSCWKASSSPSCRATPCSAMPAGSASRCATNRPGRSSVPPSPTTARASPGSTVRWWKDCWRCSTTALPRRCRPRARWAT

SEQ ID NO: 32828 - protein, 408 aa, Pseudomonas aeruginosa
ETCNETTLAALPCRHPQGRQVLDRRGRRPGHRRSADPLDRPARRTAARRLRRTHRPRWRLADPGVYRLPHPRGVRRQPQRRIRAAPGGRQLRRDRRRRRRHRQHRTRHPRGQRGRIAGQRAQAPGALAARRRDGAGDQVRLRPRPGQRAQDATSHPPPRRTPAGDRAQHLPGRPCATAGIRRARRRLHRAYLLDDAPRAGRRGTGGRGGRLLRAPGVFPGAGRAGIHRRPRAGPAGEAARRAAILAARFQPGGALPGFVGRPPGVHDRGRRPRHGRGGHRRGAAAGRLLPAARDPAAADRCPAPARRGHGHCQRSQSRHLAGAVVAPDAEHGLYPVPPDPGGGAGRCHPARRPGAGAGSQSRQPGGRQAGRLRRLGHRASGGAGLLAGRRSAETRHSPRRGGIPWMKS

SEQ ID NO: 32829 - protein, 282 aa, Pseudomonas aeruginosa
RPSSATRCSGTPTRSVPTCRTCSTADCPTSISAPTPAPVAIQRWRPAWRRSALPPKATAMCSTGASRAATSPATTASRSSTSMPSSWSWRSAPTWTSRPRSLTARTSPKRPAQSSANCWKASSPGVASATPEVLGGGGRLARPGGREGRGWGGASASAFWKFSVANLLRSALMRPGGRVRKELHNCSPLSSRPAFPSRGLRRVAPGTEYARNARLRFQEDSECSPPPTRRTSAFASKTSGTTSRYSPSAVAKPSASPFASTWSWSASDPIWTSTRCCTSRPS

SEQ ID NO: 32830 - protein, 185 aa, Pseudomonas aeruginosa
PAIARPWSRAWPTWGCAATNASSSASACRKSSAGCWRATAFSPTPTASSWARRRTRPANTARSTTKPTWRSSAGSARRKASITTMSFLPRAMCWSSATTRPPFRGCNAPSPTCRTPGWSPTSRWSSASACASTPVPAGLPGATTTSSNPRCRCRPPMARSPGRSNRTWRTTTIPAASPTASAAST

SEQ ID NO: 32831 - protein, 173 aa, Pseudomonas aeruginosa
PAPPARPSTATNTAGSRCSSSGIASARPTTTPVAGCASPPTGRANAMAASPSRGWAWKSWWVSWRAIRISRWSPAASTTAKTGCPTSCRRTRPAAFSRPTATPAAAVSTNCASRTARARNRSSSTPSATGTRTSSTTRRSASATSATTRSRAIATASSGPRNSARSMPTARSN

SEQ ID NO: 32832 - protein, 318 aa, Pseudomonas aeruginosa
STAAAAPASVAAFARCRRCNRSRPTPRRREAPCWEPSPRRSAKRRRNSCVSNSVRCPVCHRRPGNRIGSTPMVPSRRRASPTKAAQSASNRCRANAPIASRPPMATPTKWRWSTSRTHCRPTIGSPSRGSATTGRKCPSTSRVPPRTPTGATPRGPAPPTRMSPRHERPVQTADPQAIRATGRQRPADPRLVRQQGFLPAARGCAHQAADQWPGGLRRGACGDGGGPAQHRHHHLGLRPGHAFQTPRRTANRRIAADEGPRRSAGASAGLEQPTRQAQGKHHPRGRRRRFRRHLGGLGRRQRQRGGQRGAATGAAAPA

SEQ ID NO: 32833 - protein, 324 aa, Pseudomonas aeruginosa
FAFSQLDKGPSSASSPDPGLRRRSARLETGAVMRLMAIGLWAVLCLAGVPVMANSKPFVCANEKDHLPPLDPQADAWYREAAALAKPDTLRPWGRIVELYSKAVERGHWKAMHNLANLYRTGWPGGVEKDPQKALDLYQKMIDLDVPQGFYDMGAMIGNRAGVKNPATDGLTFLDKAASLGNPPALTELGKLYIYVAKEKELGLAYASCASSQGYAPASYELGSYYELVENNYPKALSYYQVSVSQGGRSAAFFLSRVFGKRTPPSSAMWYTPDEKLEKFYYSLYLQIDADPDLRFPNLVKDNPLPPHPVQGYDAARPDWKPGQ

SEQ ID NO: 32834 - protein, 138 aa, Pseudomonas aeruginosa
GNPPGGRTAGRRWTARSALRRPARPGSAAAGVPLRASVRAAPGPPIRRWRWLRRAGRGVPAASGLGPGPVRASAGPAPARANARWPVRSRSADSARSIRRSPAAAATAPGPGWRRCAGCGPVGAAGSAPGAAPPAGYR

SEQ ID NO: 32835 - protein, 266 aa, Pseudomonas aeruginosa
PCRSARSTARRIPASPITTARSSTRESASGCGSPRWSTSSASTPASSPRAWHCCASRRETRSRRAAILTPPSNGPACARPRPPGYRWWATAATATSGSTSATARSASPWPAAAGACWPSRSAAARRASIPLACFRAARWLAEFPSTWSTPMEPTRIATNDRLSAAVCFDALVFLSGQVPGQAEDIHGQTREVLAKIDALLAEAGSRKERILSATIYLKDIARDFAALNEVWTQWLPTGQAPSRTTVQAELARPSVLVEITVVAARG

SEQ ID NO: 32836 - protein, 313 aa, Pseudomonas aeruginosa
LTFHSHKKKEAEPPMKILVSSTLALSLSLAIGAAQAEELSGTLKKVADNGTITLGYRDASVPFSYLGDNSGQPMGYSVELADKVVERLKSTLGKPELKVKYNLVTSQTRIPLVQNGTVDLECGSTGVTAERQKQVAFSYGFIYVKGQLLTRKDSGIAHFDDLKGKNVVTTAGTTNERYLKNYNAEHKLGMNVVSAKDHGEAFQMLQSGRAVAFYMDDALLYGERAKARQPHDWVVVGEPQSREIYSCMVRKDDPQFLALVNETLAGLYRSGEIQGIYQRWFQQPIPPKGLNLEFPMTAELKAILENPTSDPVQ

SEQ ID NO: 32837 - protein, 182 aa, Pseudomonas aeruginosa
ASSAAGRGGGSTASARPGATRRRRPVRPDRTTAGQAVRRGRSSRLRGYRTRRRPGPSGWPGSARHARRRCGRTAPCGSARRRVRRIRARRPAGRRPPAGRSPRKTRAGRYPSSIRRIPTRSRRRAESSRCRRRPRGGPAGCVAPPPAGRRRGYGVARPRPCSFSRRQAPLLGLMVSPLPGRT

SEQ ID NO: 32838 - protein, 127 aa, Pseudomonas aeruginosa
FCIRKLNPTLATSWPSTNRMCCMPTKAVRRTDCRSSSSTAAPAPVAMPCRVASSIPTSTVSSPSTSAVAAVPRPTPAWRRTAPGSWWRTWSACASTWVSRSGCCSAVPGARPCRWPTRRPIPSGSMR

SEQ ID NO: 32839 - protein, 358 aa, Pseudomonas aeruginosa
PTSGMPPGLPGPVHVTRMTGNRHSFCQIAPNLAIYRVWQRMWRNHVRPALRCRRRPLNGQGVFSNSCSRTRGPRDFPFRFKHRFPRPRAHPAACRLDRAGIRRRPGMGVQHRRRGEQGQGPGRRQVFRADQQPAIGIQRNEIRRLPADPFHQRARLLGQAEDAVQAELLSPGHALRHAGEDQRGDRYHGQADQVRSHQVRFRIPEVRRECHQGSRLCRFPRALSDQQGRQAGRDRHLPWRELLPRGRQGPGLRSVGARPGDRYRAAFGRRVPALPRILDRAAEGAGQATGDLRPARLAAGHRRLPLRAASGQGCGDGCPGPRVPPRQGQQAGPGAADQHVPVRLQPAVRAAQLPARAA

SEQ ID NO: 32840 - protein, 283 aa, Pseudomonas aeruginosa
MALEPRSAVLRLPGRGAVTGQRDRPGRGYRGTGQGRARHAAWRERREAGRDRCPGQPAILRRRRRGRGRRGRGDPPLGRRPTALGPVDHPLAIAGVRCHRSGYRPGRRPLPAVEEPDPARPVDDLRRAGARHAVAGADLHLLLLHRHRAQPVPRVRRGCGAGAVHRRLRGRDHPGRRAVHRPRTERGRPLPGPERRPVDALRDPAAGLQARAAAAGRAVHQPGQGHLAGLGDRHHRTDQERPRGDHHLVLHLRDLVLRRRVVPAVEPAPFAHGIPTGAEARTK

SEQ ID NO: 32841 - protein, 136 aa, Pseudomonas aeruginosa
ATVGAGRPPHGYVATPAGRRPAARGWRPSVPRGGRSCPAPAVQCPPAHHGRRCVADRLRRGRRKPCGRLRWLRSGGPGRPGRARCRAAPAGAGASRPGSGGPARPGAGRCRLRMPGGLVRLAGSVPSGWRLRRAAR

SEQ ID NO: 32842 - protein, 170 aa, Pseudomonas aeruginosa
LFSSTSFGTPIAAMVCNTRRSIFGRGKASSRVIGSLAGGGWSKRTSRVASLASSFSRRPSPIQPPRRPTRRVSPFSARCTSCRCLRRRSCRTARSADTKSASSRSSRFTGGWPEAGRRRWPVGRPDARRACVPGGRTAGRSRTAATSAPRAWSGRRCPAGSGPCRPRNSR

SEQ ID NO: 32843 - protein, 271 aa, Pseudomonas aeruginosa
TARGTARRRRWRSCWCLPEGSGATARRPGCRSSARSRTGRRRSGRSPPRCAAGAYAVRSGARPGAFPGRARAARVYRRSWITRRLGRWRRGSGGSDCRRCRGVRGRNRRRAGRRRRGYARRRALGRRRRGFLRGILTGQRGQQLLRFALHREDVLVVQLPADLVRADFPFHFLLDGIETALQAADPQAGGTCGARQALGAEHQQGDQPDQQQFAEADSEHRWLPVSPCAPVLRPSAPGRRWCAAGSAVGPAGRRAGPSCRLPRCSPPCGSP

SEQ ID NO: 32844 - protein, 219 aa, Pseudomonas aeruginosa
CRFRRWPARPGSAASSSARPRLRLDTAVQGDDAAGHVVVGHAVEAGFHHHRLQGFLVGVHADRLGQVAIALGVVGDQLAHQRQQAERIGVVGLGQQVAARLGELQHQQAATGLEHAQHGADRFVLVGDVAQAEGDGHAVEVVVREGQLLGVRLDEADVAGDALVEQLVAADLEHRGVDVGQHHLAGRADQARELPGQVAGARRRCRARGSRCARRTARW

SEQ ID NO: 32845 - protein, 322 aa, Pseudomonas aeruginosa
RSHLERMPGILTGCGESAVPPSDGAGAVFCLAAYSFPICNQESIHVAYPHRTSAQPGAGRRTGQGGETGRTSGEGARRAVRMAGRRADLQTQWRRRQDRGGGGQGRGGRQARPDAVGHERPAQGRDREGAGQGAGLIPPGVRRPGGAHLPLSMRFLIFPDTLLSRCQRSGGACGFFNPTSVRCPMAKIALKKKTVSESTSLVSEIRHYARQIWLAGLGAYSRLGTEGSDYFKELVKAGEALEKKGKSLVTSQVDSANDSVKTGLSSVKGKVEDQLDRIEQAFDSRVASTLNRIGIPSRNDVEALSAKLDELSAVLERVARTQ

SEQ ID NO: 32846 - protein, 154 aa, Pseudomonas aeruginosa
TGSQGRRQACGETRGEKTRGENRGRQAGSQARRQTDCEGRSETGDQAGSQGRGEACCETCRSQAGRCDRRQARGETCRQAGCEKACGEEAGSQARRGETGRSRRVFERARCPRRHTGCQRSGSERSGDAEQPGLSPGGKAHARHSPGVFHSGPR

SEQ ID NO: 32847 - protein, 484 aa, Pseudomonas aeruginosa
PRVVVVPVEDVERRRLPAEQVVVDPVVPDQVVGAHPGEHLGHVAPVQHAMLVGAALAALQGLLVGEEHRRAFHLAVEQADQVGDATDLAQLPAHLQVAEQGGHGEPAGAGAGQVHAAAAGDLAADLDGLVEGLDIGAQAPFAVLGVGVAPTDDEDLQVVLQGVLDEALFRRQVEDVVLVDLRRHDQQGLGVLALAQRLVLDQLQHLVAEHHRALRGGEVATDLEGGLVHLAGHAAVVHQVFEQVADAIEQADPAGIEQFLYRQWIDQAVAGCHGVGEQGDEEAGAGAIVAVQVAFVDPGEQLLLPRQVGLQGAPVEGIEAPGWILEAGVLWVRLVQGVAQQHLAQLASEGDQVPRTVQRLAQAVDSQAADRRQQVLAAQADDGALCTHELGGHRHATRFLLFSHGPHSVVGPQSGCHGRSSPGSEYSVIACEFRFTRGRTAHLPEQGGCRPTVGQQALYHNAGRGVAELALSRRSQAPCAVAEH

SEQ ID NO: 32848 - protein, 157 aa, Pseudomonas aeruginosa
VRGRSRGASWTFVYSSGGRALQTALSSSSMVRFWLVKTQIEPAMFSAVSATSRALSSALCCSRARAAAWAKPPPEPMAIRPCSGSTTSPLPVMISEASLLATASMASRRLRERSVRQSLASSTAARTRCPWCFSSCCSKRSNRVKASAVAPAKPAST

SEQ ID NO: 32849 - protein, 585 aa, Pseudomonas aeruginosa
SGCMEAFAGAFARSTGAERLRRGPRAGARGRTQPGRYLAGDGRSAGPADRAEGAQGVRCETGDADGGTFAGSAWLGGRSFPPWRCAGRQGALADVGDRSGDAGMVAMKTAWLLLLLLGVGALGGCAVNPATGKSDFVMMSEQQELGMGARYNQEILKQFPRYNDEKLQAYVQRVGERVARSSHRSNLQYHFTVIDSPDINAFALPGGYIYIHRGLIAYLGSEAELAAVLGHEVGHVTARHSVRQQSQASAWNILGQAVAIGTGVGAAGDLANVLGTAFVRGYGRDMELEADGLGAQYLARAGYDPTAMIQVVRVLKNQEDFAREEAARNGQAVQAGGYHGLFDTHPDNDRRLQEVVGPARQLANGQQEVGREVFLRHLEGMPFGDSASAGVRRGQNFYHAELDFTLSYPAGWKILNQPSALLGYPADEQSFIGMKLVPHDSRLTPAEFLRKNAGQRLAQEESLKQAGLNGYTAVVPGNPARRVAVIYQGDRAYLFVGVVKVGSLETQDDRFLSVIRSFRPLRDKERALAQPRRLHLVQVKAGQTLEQLAAGGEGSLSDSVARLRLLNDLYPSGEPRPGDWLKVVR

SEQ ID NO: 32850 - protein, 363 aa, Pseudomonas aeruginosa
VLNANRELVVLGLIKKKANTLLGIDISSTSVKLLELSRSGGRYKVEAYAVEPLPPNAVVEKNIVELEGVGQALSRVLVKAKTNLKSAVVAVAGSAVITKTIEMEAGLSEDELENQLKIEADQYIPYPLEEVAIDFEVQGLSARNPERVDVLLAACRKENVEVREAALALAGLTAKVVDVEAYALERSYALLSSQLGADTDQLTVAVVDIGATMTTLSVLHNGRTIYTREQLFGGRQLTEEIQRRYGLSVEEAGLAKKQGGLPDDYDSEVLRPFKDAVVQQVSRSLQFFFAAGQFNDVDYIVLAGGTASIQDLDRLIQQKIGTPTLVANPFADMALNGKVNAGALASDAPALMIACGLALRSFD

SEQ ID NO: 32851 - protein, 206 aa, Pseudomonas aeruginosa
LRDQAGRARQHVQAAHEHPGQDLSLQRQGAEEMRARLILSSLLLASLAGCGGGSDFADLQSYMDEVRARPKGTIEPLPKFQPYEAFTYSAASLRSPFQPPVKIDLTVRQKGNKVIKPDETRVKQFLEGFNIETFEMVGTLSNAQGTFALVKGAGGVHRVRVGDYLGRNDGKVVGISEGKIDVIEIVPDGEGNWLERPRSLTLKERS

SEQ ID NO: 32852 - protein, 954 aa, Pseudomonas aeruginosa
EFLMKAGLYHPETFKDNCGFGLIAHMQGEPSHQLLQTAIEALTCMTHRGGINADGKTGDGCGLLIQKPDLFLRAVAREAFSVDLPEQYAVGMVFFNQDPVKAEAARENMNREIVAAGLELVGWRKVPIDTSVLGRLALERLPQIEQVFIGGAGLSDQDFAIKLFSARRRSSVANAADSDHYICSFSHKTIIYKGLMMPADLAAFYPDLGDERLQTAICVFHQRFSTNTLPKWPLAQPFRFLAHNGEINTITGNRNWAQARRTKFTNELIPDLEELGPLVNRVGSDSSSMDNMLELMVTGGMDLFRGLRMIIPPAWQNVETMDADLRAFYEYNSLHMEPWDGPAGVVLTDGRYAVCLLDRNGLRPSRWVTTKNGYITLASEIGVWDYKPEDVIAKGRVGPGQILAVDTETGQVLHSDDIDNRLKSRHPYKQWLRQNALRIQATLDDDHGVASYDADQLKQFMKMFQVTFEERDQVLRPLGEQGQEAVGSMGDDTPMAILSRRIRSPYDYFRQQFAQVTNPPIDPLREAIVMSLETCLGVEQNIFEEAPHHANQAILTTPVISPAKWRTIMTLDRPGFDRHFIDLNYDESMGLEAAVRNIADQAEEAVRGGKVLLILSDRHIAPGKLPVHAALAVGAVHHRLVQTGLRCDSNILVETATARDPHHFAVLIGFGASAVYPFLAYEVLADLIRTGEVLGDLYEVFKYYRKGISKGLMKILSKMGISTVASYRGAQLFEAVGLSDEVTDLCFTGVASRIQGARFVDIENEQKLLAAEAWSNRKPIQQGGLLKFVYGGEYHAYNPDVVNTLQAAVQQGDYEKFKEYTALVDQRPVSMIRDLLQVKTAAQPLALDEVEPLEAIFKRFDAAGISLGALSPEAHEALAEAMNTLGGRSNSGEGGEDPARYGTLKSSKIKQVATGRFGVTPEYLVNAEVLQIKVAQGPHAPARAASCRAARSTA

SEQ ID NO: 32853 - protein, 480 aa, Pseudomonas aeruginosa
GFDMSERLNSDRLNNDFQFIEVGRKDPKKKLLRQRKREFVEIHDLFKPQQAADQAHRCLGCGNPYCEWKCPVHNFIPNWLKLVSEGNILAAAELSHQTNTLPEVCGRVCPQDRLCEGACTLNDGFGAVTIGSVEKYITDTAFAMGWRPDLSKVKPTGRRVAVIGAGPAGLGCADVLVRNGVTPVVFDRNPEIGGLLTFGIPEFKLEKHVLSRRREVFTGMGIEFRLNTEIGKDVAMEQLLDEYDAVFMGMGTYTYMKGGFPGEDLPGVHDALDFLIANVNRNLGFEKSAEDFVDMKGKRVVVLGGGDTAMDCNRTSIRQGAKSVTCAYRRDEENMPGSRKEVKNAKEEGVKFLFNRQPIAIVGEDRVEGVKVVETRLGEPDARGRRSPEPIPGSEEIIPAEAVLIAFGFRPSPAPWFERFEIATDSQGRVVAPAQAQFKHQTSNPKIFAGGDMVRGSDLVVTAIFEGRTAAEGILDYLGV

SEQ ID NO: 32854 - protein, 380 aa, Pseudomonas aeruginosa
QRASVQAALLQQAEQQARVGSGDGRCVGVRAAAHAGVSWPEMIGSLARARLPLHWLVPRYCPATQSSGERAMHPWARRNIPQLAGRLALVTGANSGLGWQAARTLAGKGATVVMACRNREQAERARRAILDEYPQARLELADLDLADLASIRACAAGFRQRHERLDLLFNNAGVMFLPLRRTRDGFEMQMGTNHLGHFALTGLLLESLLAAPRPRVVGMTSGFNQFGRLPLDDLNAERGYNRYLAYCHSKQANLLFSLELQRRAGQRGVLLQSLAAHPGYAATNLQYAAPAMAGSRLGRWAMKVANGAFAQSAEMGALPALSALTEQRWYGGAYVGPDRWLETRGYPAAARIPRNARDLGLAARLWARSEELTGVRFWSE

SEQ ID NO: 32855 - protein, 76 aa, Pseudomonas aeruginosa
SDEAWPLARRARRPIQLLATECAPKKPKVNSSRPASISGIGSNRVSSRPPSISRMTAQSTLRRPSLSASEPTQAEL

SEQ ID NO: 32856 - protein, 94 aa, Pseudomonas aeruginosa
VIATAARPLKDSPTSARISSTPCQVGITALPRVNSAAASSETTITGLRPIASEIGPVTSRPRASMAVATDNARLLSAALMENALDSTGIIGWMQ

SEQ ID NO: 32857 - protein, 311 aa, Pseudomonas aeruginosa
YVKRPNWRGRVELRHLRYFIAVAEELHFGRAAERLGISQPPLSQQIQALEEEIGARLFERTNRRVELTDAGRLFLDESRQVLAQVDKAVLLARRAHLGELGELKIGFTSSAPFTSTIPSSIHAFRKAYPDVHLDLQEMSSRQVLKALLEESLQVGVIRPLALPDAVHWVELFREPLVAVLRADHPLAAGSEDGLAIAALAEEPFVFFPRSYGTGLYDQVIALTRQAGFSPRIAQEASEAMTIIGLVSAGLGVSILPASFRRTRVDGVVYRTLSDPEATTAVWLVRRQNEGSPLALSFIDLVTREAASLRRR

SEQ ID NO: 32858 - protein, 285 aa, Pseudomonas aeruginosa
TALRQDRDGARACPRLCLSSGIRLGSRRFPMRRVVFNQKGGVGKSSIACNLAAVSAAEGYRTLLVDLDAQANSTHYLTGLTGEDLPVGIADFFKQTLSSGPFSKKGRVEIYETPFDNLHIVTSSPELADLQPKLESKHKINKLRKLLDELDEDYDRIYLDTPPALNFYTVSALIAADRCLIPFDCDSFSRQALYGLLQEIEELRDDHNEDLQVEGIVVNQFQPRASLPQQLLDELVAEELPVLPVYLMSSVKMRESHQACTPLIFLEPRHKLTQQFVELHGLLES

SEQ ID NO: 32859 - protein, 133 aa, Pseudomonas aeruginosa
PRACAGAATPGLRLLPRRAGGRPRPSGRRPRGRRSRRAGWPAPAPEFLRRVGGRTASNPPRCPACAATVPGPGPGRSPRRRPGPGAGASGRGSGPGRGAGTGRGWRAVRPLPPVASAPGPGRPGSNGRSVPGC

SEQ ID NO: 32860 - protein, 134 aa, Pseudomonas aeruginosa
SPRRAAGRGRRPGAGYRSRTGGRNTPSPAARPPTTACARRTVRRTALRRWFPLAGRAAPGRRGWLPPGAARRWGRAGLRWRRRRPGGRSGCRSRGRRVISREASGNSRALCWELPEGVQALRFSGSVRRDRPGP

SEQ ID NO: 32861 - protein, 94 aa, Pseudomonas aeruginosa
SEATADSWASPSSTKSPKKRAPRPRSGAWLNSLPRAGRSCSWPITQRMSSASRMVLPDGWSSSVPRNSAAIRVPPGIFSSRRAAPMHHFSLFRW

SEQ ID NO: 32862 - protein, 168 aa, Pseudomonas aeruginosa
TNSSHSLVGWISRPARDIGAGSGGTTTRSSLAAQGRLVPCTSSETRTMKKATLKNSWAFGRPAISGNTARMIGTAPRRPTQAMKAFSRSWKARNGISPISTDSGRATRIIHSARASAGRAIGHRSWGVTSRPRTRNMPICASQAMPSSMCRMPWRLRIGRLPRSRPHR

SEQ ID NO: 32863 - protein, 160 aa, Pseudomonas aeruginosa
RPPARCMRLISCSSNQPPPRPSRAPRPNCCTRCRAKPQLRPVWPLASISIRVTVRNTAIGSLLPDSISRVAVTRSLRPLPPSRENTAAASVEPTMAPISRPSIQCRSNSQAAAMPVRPVVTSTPRVASDNAGQSATRKLETRVRRPPSRRITASARLPTR

SEQ ID NO: 32864 - protein, 346 aa, Pseudomonas aeruginosa
RSPTNIDMRDTRAKPATARPLPKPREAGRIRAPRPWARACADAGSARIRRGRAVRLAALPGAVQGAVIMNYRHAYHAGNHADVFKHLVLARIFALLGRKDTPYAYLDSHSGVGLYDLQGDEASRTGEWEQGIARLWEREGLPEQLDDYLDVIRHLNPDGSLRYYPGSPELARRLTRAQDRVLLNELHPEDGRLLKANMAGERRVAVHQGDGWLLPRAFLPAPEKRAVLLIDPPFEQADELQRCVAALDEAIGRMRQTVVVIWYPIKDERQLKRFYQALERSVAPKLLRAELHVHPIDDAERFNGSGLAIVNPPWPLEDELRDLLPWLAEVMAQSQGGWRLDWLVAE

SEQ ID NO: 32865 - protein, 225 aa, Pseudomonas aeruginosa
SSGRQAHPGAAQAAVAVGVLRQVLLVVGLGVVEGRDVGDLGGDAVVAGFRQFGLEALPAGQGRGLLGRVEGVDHRAVLGADVAALAHALGRVVGFPEYLEQLFEAGLLRVVDHQHDLAVAGQAGADFVVGRVRRVAAGITHRGHPDTRLLPEATLGAPEAAHAEQHLLQAGGERRGQRAAVDEVRFGHRHGAFATRQGLVRRGQLAFLGEDFRTQNHGSRLLLRG

SEQ ID NO: 32866 - protein, 603 aa, Pseudomonas aeruginosa
RVAGAEVVHRQGQAEALQAFELLAGIVGGVQQQAFGELQFQLAGRDVLFVEDRRDRADQVRVGELLGRQVDGDLQLAQPGLGQLAGLATGFADHPLADRHDQPGFLGHADEAVRADHAFFRMLPAQQGFQAEQLAAAQAQLGLVVHRQFVLRQGAAQVALDEQLVAGLGGQRLGEHLDLVLAVGLGLVQRQAGVLHQGLRVAAVLRGAGQADGAGDVDQLVVDEQRLVEHVQDLRGNAFALFHRGVVEQHGELVAGEARQGGAVAEATAQAPGQADQQLVAGLVAEAVIDPLEVVDVHQQQAERAVAAAFQAFLEGADEIVPVGQAGEVVAVGEFLDVLLGQLVLRDVFVDADVVGQLAEIVVDLRQRQLAPVRLVVLAAAAELALPAVLLGQRGTRVEQQLAEVLQRRKLGQASVTHFVGAVLGDRGEARIDVFHHAVAVDQQEGAGALFHRALEQVQGAGDIASLVVHQDLRVLVGEFPGEGDLVALPHAVLAGVFQAQHADHLAADADGGVEQGVDAQRLQVVLVEFLGAWVALGRCGRRWRARCVPPRGRRGSGWRRCSGASRTGRGRGGRRSPLPGAGRRAGARCRRARCRRLRRRPG

SEQ ID NO: 32867 - protein, 143 aa, Pseudomonas aeruginosa
SVARLPAAGRWTGSDGGPGGRSGSAGCASAAGVAGGRPGSAGRGPGTPSGAGSAIPGRATVRCARRSPLAPRPSGSRAATGGHAAGRLRRTPAWSARRWVCAACSSPGSAGASPVAAGSARAGGGGPRVPSGWRKAHRAVRRG

SEQ ID NO: 32868 - protein, 983 aa, Pseudomonas aeruginosa
TMSLPSLANLPATLLPAAERAGTALRSAVAALDAAALARLEAWPEERLEDFRRVAAASDFVAEQAVRDPAMLLDLAERGELENPHAPGELRSQLQARLEDCADEDELGRRLRRFRTRQQLRIIWRDLTRRAALAETCRDLSALADACIDLACEWLHRRQCEQFGTPIGRRSGEPQRMVVLGMGKLGAVELNLSSDIDLIFGYPEGGETEGAKRSLDNQEFFTRLGQKLIKALDAITVDGFVFRVDMRLRPYGSSGPLVYSFAALEQYYQDQGRDWERYAMIKARVVGGDQQAGEQLLGMLRPFVYRRYLDFSAIEALRTMKQLIQQEVRRKGMSENIKLGEGGIREVEFIAQAFQLIHGGRDLSLQQRPLLKVLATLEGQGYLPPAVVEELRGGYEFLRYAEHAIQALADRQTQMLPSDEYDRIRVAFIMGFASWAAFHERLSHWRARIDWHFRQVIADPDEDESGEAACGSVGAEWIPLWEEALDEESASRQLADAGFVDAEAAWKRLSDLRHGPQVRAMQRLGRERLDAFVPRLLAMTVENPQPDLVLERVLPLVEAVARRSAYLVLLTENPGALERLLTLCAASPMVAEQIARFPILLDELLNEGRLFRPPQAAELAAELRERLMRIPEDDLEQQMETLRHFKLAHGLRVAASEIAGTLPLMKVSDYLTWLAEAILVEVLELAWRQLVQRHGRPLRADGTPCDPDFVIVGYGKVGGLEFGHGSDLDLVFIHDGDPQCETDGGKSIDGAQFFTRLGQKIIHFLTAQTPSGTLYEVDMRLRPSGAAGLLVSSLGAFQRYQEQEAWTWEHQALVRARVLAGCRRVQASFEAVRAEVLARPRDLDALRTEVSEMRAKMRDNLGTRATAAGTASNAFEATAAFDLKHDAGGIVDIEFMVQYAVLAWSGEHPALLEFTDNIRILEGLERAGLIASEDVRLLQEAYKAYRAAAHRLALQKEAGVVSGEHFQTERREVIRIWRELRLG

SEQ ID NO: 32869 - protein, 345 aa, Pseudomonas aeruginosa
MRILIVGPSWVGDMVMAQTLFQCLRQRHPECVIDVLAPEWSRPILERMPEVRQALSFPLGHGVMDVATRRRIGRGLCGQYEQAILLPNSLKSALVPWFAGIPKRTGWRGEMRYGLLNDIRKLDKQRYPLMIERFMALAFEPGVELPKPYPQPRLRIDDGSRQAALDKFALSLDRPVLALCPGAEFGEAKRWPAEHYAAVAEAKIRAGWQVWLFGSKNDHPGGEEIRQRLIPGLREESFNLAGETSLAEAIDLMSCAGAVVSNDSGLMHVAAALDRPLVGVYGSTSPQFTPPLADRVEIVRLSLECSPCFERTCRFGHYNCLRELPPGLVLQALERLVGDPAEVAG

SEQ ID NO: 32870 - protein, 203 aa, Pseudomonas aeruginosa
PATWARRRSPVSIATRRASRSPAASIAVPIRSPGDSMRWSARASCSPRRWTTRCPSRSVTMAWTASSWPTPTLARRTWCSCTVLPGTPSIGRKPTGANWPSACASAAGRCACPGAAPPSGSGPGAWRRGWKMPRYSPDYPWPAWPRCLPARAPAWRWIPASVTWRRRWTCRRCRCSARPILASPAPTGAPRSTWAATSPVRRA

SEQ ID NO: 32871 - protein, 660 aa, Pseudomonas aeruginosa
IPSAWPPSWRPCCWPRRPSDDPGVHPLQILPLRRPAARLHAHRPGMSAARARHPRLYADLGGRRAGRLRSAGGPGALDLQPPAQREVHRVGPRRPGQAPGAAGDRLQQDARTGCLLRRRRLFRGKGPDLAQPAVPPVGPLPPLRRLRTGSVRPGLEDRDPDDLRGAAAALRQALRHPGRAFPSAAAGDQPGSPGAGQRRGRACGIPPRVRPGGGRPAAGADRFRLQDQGPGSQPEGAVRAAQGAAQAYPADRHRPGRSQAVPATDRRPRSQRPGTDPQGAQRYPALPARRRPADPPGLQREHRYGAAGGAGLRPAGVGDRCLRLCPLHRRGRRRAGAAESLRAGQSQPPARGNAGGRSGARRLVAQWPGLRRSRRPLQHAAARRRPDPRGGLMRLVLEEPFKRLWNGRDPFEAVEALQGKVYRELEGRRTLRTEVDGRGYFVKIHRGIGWGEIAKNLLTAKLPVLGARQEWQAIRRLHEAGVATMTAVAYGERGSDPARQHSFIVTEELAPTVDLEVFSQDWRERPPPPRLKRALVEAVARMVGDMHRAGVNHRDCYICHFLLHTDKPVSADDFRLSVIDLHRAQTRDATPKRWRNKDLAALYFSALDIGLTRRDKLRFLRTYFRRPLREILRDEAGLLAWMERKAEKLYERKQRYGDLL

SEQ ID NO: 32872 - protein, 762 aa, Pseudomonas aeruginosa
TNPTRSVFARWWLSSRGANERFHRRAGPRPAPAQPSGQLRRPVGLAAGRRGRTEYRAGWLEQRLPPRPGRLRLLPEAPEQPPDPQPAPSAGRADLRPRVPQHRALPGAGHSRPAGGVLRPAGGRRRAPGDPPDPCPGRLAGPGHLAGVLARPGRRAAPGDSPGGWQAGAPAARRRTDAWLLLSQACIPPRGGRWCLRGLPDRPGEDPPDLVRPPRPGQGPGADAAPCPGLERSGRARIHLRLCRRTPRLGRGRAVVSPSRPAPSAQGVAPMRLAELQAAGRHPQLPLRVTLADGAGAAELRLDSLLRVLPGQRYVGAGEWRGRKVLAKLLVGGKAARHFQRELEGARLLAAQGLTTPALLADGLQQGEGGWLLFDYLDAAQSLGDAWRAVEAQAPLGDAQQAVLGEALAAIGELHAKGLWQDDLHVDNLLRHAGRLYLIDGGGVRAETPGQPLSRQKVLENLGVFFAQLPALLDPFLEELLVHYLLANGEHALPLEALQKEIAKVRRWRVRDLLRKVGRDCSLFSVVRGPFRLFAARRSEAETMAPLLADADRLIAAGHVYKDGGAATVARVEANGRTLIIKRYNIKGWVHWLKRFWRPSRAWASWREGNRLEFLGIATARPLAMLERRWCWLRGRAYLITDYLGGQDIIARFKPCLDMPDGAVSPPEAELAALDRLFSTLIRERISHGDLKGHNLFWQAHEQGGEWALIDLDAMRKHHSQASFARAYARDRARFLRNWPQDSGLYRLLEQRIPRLGDAAGA

SEQ ID NO: 32873 - protein, 212 aa, Pseudomonas aeruginosa
GRSRRYPSVPPVQPPAPGQRCRRPVDLEQSAVRSPRADPAGTSRGHRPASSAFRSAPGPCPRPGGCARGAPGPGLAAAGIVALCQSPARQRSLADGRCAHGGQPATADRRMLAVAAMDAGAGAHAPGGQGHGLGHDARPATQAAVQAPSAPPSAGLARRASLAGLRRGRVHAQGGASARVVLGGVAGWGGVMLGSSVRQGSSRHAASEQPRG

SEQ ID NO: 32874 - protein, 605 aa, Pseudomonas aeruginosa
ETMSDSPQNPGPSSLKIYFRLLGYVKPYIGMFLLSIVGFLIFASTQPMLAGILKYFVDGLSNPDAALFPNVQWPWLRDLHLVYAVPLLIILIAAWQGLGSFLGNFFLAKVSLGLVHDLRVALFNKLLVLPNRYFDTHSSGHLISRITFNVTMVTGAATDAIKVVIREGLTVVFLFLYLLWMNWKLTLVMLAILPVIAVMVTTASRKFRKQSKKIQVAMGDVTHVASETIQGYRVVRSFGGEAYEEKRFLDASQSNTDKQLRMTKTGAVYTPMLQLVIYVAMAILMFLVLWLRGDASAGDLVAYITAAGLLPKPIRQLSEVSSTVQRGVAGAESIFEQLDEAAEKDQGTVEKERVSGRLEVRNLSFRYPGTDKQVLDDISFIAEPGQMIALVGRSGSGKSTLANLVPRFYQHNDGKIMLDGVEVEDYRLRNLRRHIALVTQQVTLFNDSVANNIAYGDLAGAPREEIERAAKAANAKEFIDNLPQGFDTEVGENGVLLSGGQRQRLAIARALLKDAPLLILDEATSALDTESERHIQAALDEVMKGRTTLVIAHRLSTIEKADLILVMDQGQIVERGSHAELLAQNGHYARLHAMGLDEQAPAPVG

SEQ ID NO: 32875 - protein, 416 aa, Pseudomonas aeruginosa
PADHRQAAGHESSPATAAGRLRGTVPHRRGGPGRGRRVAAGQGQGAGAVRLRQGRATEPPGADPGGAGAQHSGTGRSQGQGLRHLSRRQPDHPEPVRIRDHRRPLRRRSRTGRQGPGADERTRPRCLAGDPRRAWHDPAPRWPAGPAPAGAGAGSVRRHRCRRYGHLHPGRGACRRRGAAVRGGPGQPGRRHRGRQAGYRGDQRARTASRGAARAGFRAWRAGPGAIAAGNRRRPRPRREDRLHQWLLRHPSRRPRDLPRTGARPGRPPDRRGQRRRLGHSPEGRWPADQLGGPAHGGTRRARRGGLGGELRRRHSRAPARAGASGRAGQGRRLRRRAGGRRADRQGLRRRGTGARPGGEQLHHRHRREDPPALIPVSRFFPLHADPWPCGWIIDVPAKPGTSIHSRAGLASFFFR

SEQ ID NO: 32876 - protein, 76 aa, Pseudomonas aeruginosa
ELNAVVVGQVIFKALKSVKKCKVSARLSAFPEFPRLESAVLRDGFRQNADLSGQVTGWSDKFSRRDGHRRCPCGGA

SEQ ID NO: 32877 - protein, 249 aa, Pseudomonas aeruginosa
VRQRDRLDQVRPAHRPAAAAGRCRPARGMGRDGATAVDRRQHPCRRGRDRPGSPPAPAGNASRRVADPGAAPSGTLRRRPRAMPPRRLRHGPALRRRAGGTRDPGAARRYHGRAAVPLCPGRHRFRRRQPGAQRRAQPAGAGGPGQAGVRRSAPVQLPRHRRAIARRRGAARGDGCRRAVRRPRAPVGAAGGRDGHGHCRREGAAQQPGRPGAAAGGVGAVARARRVALAPSALPWPCIATGRFRTSAG

SEQ ID NO: 32878 - protein, 634 aa, Pseudomonas aeruginosa
HQGIDLLEQHRLAAGAVLHVHRGIVAAVQAGVGRDRDTQAVQFAGQLVAHVQRQALAAVGAVHRQAYLVALAYKLFRDTGADPVAPPVGDQHRATDPHLAAQHLPGIHHLQLAAALERRPIGFGAGGDDHQVRPFALHQRAVDRRVAAYLDAGQLHLPLQVGGGAAEFRAARQQLRQVDLAAELGAGLAEHYLVAALCRHRRRLHPRRAAAGDQHALAPRGRIGRCVGQLAAGFRVLDAGDRIASVEMSDAGLVAGDAGAHVVAAPGLGLVRHLRVADQRAGHAADVGLASGEDGLGLLGLVDAPGDEQRDRQARLEGTGFAGQVGRLDGHRRDDMNGAAEGGRSAGDDVQVVQLALDRLGRLQRLAFAETLGVALVGGQAQADDEVLGGGRAHRRQHFAEETQAGIEVAVVAILAAVHPRVEELRRQVAVAGDHLHPVQSCLVQAARGGGVAGDDLVDQRLVEFARHHPEPFVGRGRGGIGHRQQAVGGLHDLAPGMEDLRQHHAAFGVAGLGDPPVAGDAGIVGGHQHVRGVARAVVDPRHLHDDQSGAAAGPGAVIGDEWLVDQVVGRHRRVVAARHDAVFQAFAPDFQGAEQVREIHGWRPSCCSRGALQKQDMNLPSVKNQLVFLKSTG

SEQ ID NO: 32879 - protein, 120 aa, Pseudomonas aeruginosa
RPPTPGRIADAHRAGRNLALVWQGSLYGMDYWAVVKGSKRGAEARRFIAFANAPDAQVRYVENIPYGPTNRQAAQRLPAQLASWVPTAPANLEQGLAMDDEFWVEHGEELEERFNAWASQ

SEQ ID NO: 32880 - protein, 1224 aa, Pseudomonas aeruginosa
RPLRRQRRAGGSLPCRVRPSRPAGRAGAAGHPPARQGRPDPDPRAAGALRGGDHPDHRAQRRDRSHRRPGVRRRRLRDQAAEPARTGVAGEESDPPGAPCPGQRRPRPAGPQAVRRLAAGRRPAPPDRPRGQRNPAHPWRIPIARRFPAQQRAYPEPRPVDGPDPQPRVAAQRSLHRRAGRPPASQAARRPGRTATDHHHPRRRLPVHRRGQRRLSHAGLLAGALRMAAGRPGTGCGDHPLLRLSGIPADLLERRPAGPGAGAGAGEAAVRRAGLPGRGGGAGQLAALPARRRRRTGRPDTGLPHARARSRPGVFRRAGAARGRGDLLQPPAAGAHPIPRRPRRLSRRAVVRRKLRGGLRPLRRPPRQRRMGFRQPTELRQAGAPAHRLHRPRTAHRHAVRRAPGRRREHPCAARTADGGLPAGGGLAALAAGGEDGRDRPGPAWLSRRRQHPALAGRQRARLSAPRRQPRGRLVSGHGGVLARRLLWRVLLFSLCFTVLAGAVQLFFEYRREMREIEARLELIRSGYLASFERSLWDLNQEQLNVQLRGLGDFPDIARVSLQSADFNLLQGDQRPRGMLRVERFPLSYQPPGGERRQLGELEIAIDLAAVYRRLVSGGLASLLWMGSFLCGLAVALSWLFHSLVTRHLWRMSEFAGHIAEGDLQQPLRLDKVDRERDEIDAVAAALEDMRQALRTDRRRRDADRDELRRQVERRTASLRRAKDQAEAADRAKSRFLATMSHEIRTPLNGILGMAELLREASLGERDRQRLRALATAGEGLLAILNEVLHFARLEEAPDVPEAVDFSLRSLLEDVLTLLEPRARENATRLDLWLDPQVHDGHRGAEQFLRQVLTNLLGNAVKFTEAGEVRVRVERLARSAGSERLRLSVADDGIGIPEEMRERIFERFTQGGDAVTRRYGGTGLGLAISKRLVEALGGRIGVESRVGQGSTFWFEIELALASLSGATPPAASVSALEVLLVEDVALNREVAQGLLERDGHRVMLAEDAGPALALCRQRRFDLILLDMHLPGMAGLELCAGIRRQLDGLNRSTPIFAFTASIQPDMVRRYFAAGMQGVLGKPLRMDELRRALGEVGTSVPALAVEAALDRQMLETHRRLLGRHKLAGLLGNLLGSLDEQLPLLAEALDQADLAEAANIAHRLSGSCHSMGLVALGAGLGELEREALGAAGVDPRAWGARLGSLRRDGAEALRRAGFLGEADSAAG

SEQ ID NO: 32881 - protein, 485 aa, Pseudomonas aeruginosa
AISKTPVRTLIRRCAMADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLMESPFVQVFDMVGIPYAADLMNFVILTAILSVGNSGLYASTRILWAMSRTGMAPRGLSKLSARGVPLYALLITLCFALLSLLTSVVAADTLFMVLMAVSGMSGTVTWIVIAYAQYRFRREHMASGGTVAGLKYAAPLFPLVPLACIAVCCSLFVFLALDPTQRPSLYWGFGFIAACYLAYYVVRRRQPQGLGDPALGRAG

SEQ ID NO: 32882 - protein, 277 aa, Pseudomonas aeruginosa
KPRSPSTNNKNEGRMTDLSPLQTRVEAGIAWLVLNRPQQRNALDIPTLEALHVRLDACERDPAVRAVVLGGSGRSFCAGADLAEWAAAEARGELESYGWTEAAHALMGRLHALDKPTVAAVNGSAVGAGMDLALCCDFRIAAASARFKAGYTGMAYCPDAGASWHLPRLLGSEAAKRLLFLDEAWSAERALGAGLVGEVVADERLVETVGAFAARLASGPTFAFAQTKRLLRDGAGRSLAEQLRAEQAAGLLCGRSEDAAEALRAVAEKRSPQFSGR

SEQ ID NO: 32883 - protein, 142 aa, Pseudomonas aeruginosa
PRNRTCWSRRCAASSRRNCCPTRTMSTAPTRCRRSWPHRFAARPSPPVSMPSTCPRKWVAAASTTCPRRWSNASCRRSPGPSTYSSRGPRRSSWPAPENSSATTCCPACRAKRPIASPSPSRAPAPTPIRSRPARCATATPS

SEQ ID NO: 32884 - protein, 479 aa, Pseudomonas aeruginosa
LERCRGAPPWSWRAVHRGIAGGGGAPGCGPATNAHRRRRRAGGRRCACRAERAPGRAAVHQRRRQGPAAAGRAAQRRGQPVRSAGLGDDRRGRPGAGGGHRDGRHRLLARTPAAVGRTDPRRYRPAQVQRLLSLCRSAQGRCPADPGGAAGAPAAGGPRRRAGRREGGAPARGYPRGTRAAAGAAPGDPRPDRRRAAGRCFRQHRHDPTGLYRQLRVRQPSAAQLAASHRLRHPRLRPAGRHRRQARRPAAPGPGAGRRWRLPLHRAGTGHRQRGTGQSAGGATVEQRRARPDPRRHARPGHRAGRRAAAQPRLRPAGPRLRLRGAPAAGPERTGARPARRLRAARRDPDRTAARLCALTAGQGEHPCAIPTSLNVSPATAPLPGTSTIARWRGSSRARKSSCCRSATPTSIPRRPSSRRPSTACWPATPTTPTCAASAPCASASPSATGGAAARRWTRSRWWCWQVPNARCTRWCSAC

SEQ ID NO: 32885 - protein, 677 aa, Pseudomonas aeruginosa
RPVPPRADRSNPRREQDVRAMPALPARPSRHQSRWPRVPGSPDNHPGEPSMSATQKNNITRLEQLDRQSTQPFPNSRKVYLTGSRPDIRVPVREISLADTPTAFGGEKNPPVFVYDTSGPYTDPEVRIDLRKGLPDVRSRWIDERGDTEILPGLTSEFGQARLADASLDALRFAHVRTPRRAKPGANVSQMHYAKKGIITPEMEYIAIRENMKLQEARAAGLLDQQHPGHSFGANIPKEITPEFVREEVARGRAIIPANINHTELEPMIIGRNFLVKINGNIGNSALGSSIEEEVEKLTWGIRWGADTVMDLSTGKHIHETREWILRNSPVPIGTVPIYQALEKVNGVAEDLTWEIFRDTLIEQAEQGVDYFTIHAGVLLRYVPLTAKRVTGIVSRGGSIMAKWCLAHHQENFLYTHFEEICEIMKAYDVSFSLGDGLRPGSVADANDAAQFGELETLGELTKIAWKHDVQVMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARAFHDETLPKDSAKVAHFCSMCGPKFCSMKITQEVRDYAKENGLSDESKAIEAGFQEQAARFKDEGSVIYRQV

SEQ ID NO: 32886 - protein, 209 aa, Pseudomonas aeruginosa
SESRMSETFKPAPGDVELVQREECFRGFYRLDRLRLRHRQFDGSMGREISRELFVRHDAVCVLPYDPQRDCVVLIEQFRVGAMQKLANPWLLELVAGLIDKDEQPEEVAHREAMEEAGLTLGALWPITQYLPSPGGTDEVVHLFVGRCDSEGVGGVHGLPEEGEDIRVHVWPLEDALQAVRDGRINNAASIIALQWLALNRAEVRGLWA

SEQ ID NO: 32887 - protein, 216 aa, Pseudomonas aeruginosa
ARRWPRRCAGSPVTTTNASRCSGRPRAATCWSRSSTSATGAWCCSTRAFPARCRAISRTTSSTCCGVPSTAPANASCWFPSITTRCRSAATGWTPSACATRRRCSTCWHPIRRCVACCGGTFTRSSTASAARCACWPRRPPACSSPPAAATSPSTAWRRATAGCACTTTGAWKRGSRGSTTSSSKWTTTPPDTDMPPGRGMPRPRASLPIGAQAGR

SEQ ID NO: 32888 - protein, 236 aa, Pseudomonas aeruginosa
RPHGYLQRRRHRSPFRPRPGAQAPGDVHRHHPPQPPGPGSHRQQRRRSPGRPREERAGDPAPGQLAGSHRRRPRHAGGHPPGRGRAGRRADPYQAACRRQVLEQELPVLRRLARGRHLGGERALDPGRGTRQARRQRVPDDLRRRLQGQRPGSHRHGRQAQYRYQRAFLAGSEVFRFGEVFGQPPQACAQGQGGAVPGPERGVRGQEHRRARRVALRGRPALLPDRRGRRAAAPAR

SEQ ID NO: 32889 - protein, 214 aa, Pseudomonas aeruginosa
VGAGKLRQPDSHGPGRHPCERPAPGPARRHARILRVPQPVAARRQAGARGRLGTDRLRPLDEDAGTAVLRADQGAPVVPRGGGVRLGRGEGRLQPVAQRARRNRPATGGTGDQQRRASPQGGQEGRAQEDHPGAGAARQTGRLRRTGTDARGTVPGRGRLRRRLGEAGAGQGIPGDHAAARKDPEHLGSGRRRGARQPGGPRHRGGHRRRSGCQ

SEQ ID NO: 32890 - protein, 137 aa, Pseudomonas aeruginosa
PGPAALRQDLYPRGCRLRRAAHRHAALRAVRPPFPPAGGSRPRLRGDAAAVPHRPRQGHLLRPRRSRARRHPRAPGRREEARQAAGHPLQGPWRNESVATARDHHGSEYPAAGPAHPGGRHRYPGDHGHAAGQEARR

SEQ ID NO: 32891 - protein, 354 aa, Pseudomonas aeruginosa
PQVLAGKQGQPGRGAGLMRRLLAILGLFGGLVQAAEAPPEPPVPAALSFISEHAVEGMRGGNLSGLAWCGGALWTVSDRDDDRLYRLQPSAEGSDQPWQAEAESFIAPTPPDSGLPWGMSTRVWLSGLVRGGNLDFEGIACDAAGNRYLVSEAHAAVLQLPVSGAPNWLRLPPGLLSQARASGMLMNFNALFEGIAVDPEGKRLWLAAERERRGLLVAHRDNSAWRCEGSCVLLAEGGKIEPPPELGSARKLPKDFSDLAFYRGKLFTLERLAHQICRRDLAQAKVERCWSFASAVLAPERRYELPYGVAEALSLDDKGAWLGIDNGDHARADGDVRPFVLRFAAPAGGWLGDK

SEQ ID NO: 32892 - protein, 780 aa, Pseudomonas aeruginosa
NNSNSPSATAPWCCAKTLLREVRMSESLDLSLEGVERRSLAEFTEQAYLNYSMYVIMDRALPHIGDGLKPVQRRIVYAMSELGLDADSKHKKSARTVGDVLGKFHPHGDSACYEAMVLMAQPFSYRYPLVDGQGNWGAPDDPKSFAAMRYTEARLSRYSEVLLSELGQGTVDWVPNFDGTLDEPAVLPARLPNLLLNGTTGIAVGMATDVPPHNLREVASACVRLLDQPGATVAELCEHVPGPDFPTEAEIITPRADLQKVYETGRGSVRMRAVYRVEDGDIVIHALPHQVSGSKVLEQIAGQMQAKKLPMVADLRDESDHENPTRIVIIPRSNRVDVEELMTHLFATTDLETSYRVNLNIIGLDGKPQVKDLRQLLSEWLQFRIGTVRRRLQFRLDKVERRLHLLDGLLIAFLNLDEVIHIIRTEDQPKAVLMERFELSEVQADYILDTRLRQLARLEEMKIRGEQEELLKEQKRLQTLLGSEAKLKKLVREELIKDAETYGDDRRSPIVARAEARALSETELMPTEPVTVVLSDKGWVRCAKGHDIDAAGLSYKAGDRFHAAAPGRSNQYAVCIDSTGAQLLAAGPTACRPRGARASRSGGPADAAAGGQLRMRAAAGRRCAVRDRFRRRLWFRGQGRGPAGQEQGRQGPAQPAQRLRRGGAAPGARCGAGLAGGRDDRGPSAIVQGLRPAAARQGQGQQDHRHPRRTRGQPRGIPHRPGCSASRGNVGPAGRKAYPVAQGRRPGTLQGRARPSRQQAAARIPARRQPAGGYSATGLK

SEQ ID NO: 32893 - protein, 155 aa, Pseudomonas aeruginosa
TGWARGATRRNAAATRPGLPPRAAAGAPLRHASGWPARARSRPPPDATAAAGRAGARFARRACAPAAGLRSAAGPGTDRSGAASAACAARPSSGARRWPGHWRGECSWPAGSASGRDRAGHRVAVAGAGATDGRGRYAGLEPAGDGRRRAGDSPG

SEQ ID NO: 32894 - protein, 87 aa, Pseudomonas aeruginosa
PTAVAASVRPAPGRSAAGACRAVRAPLAGSVRPVPARVAAIAPATAGGRWPAPRPEPWSAGCPSGFPARAWPGARRTGRWPAAWRAG

SEQ ID NO: 32895 - protein, 406 aa, Pseudomonas aeruginosa
GPPPGFPRGCRGRSRRDWPRAGWTTPASGCPATGRRSRAASGGCRSARRAGRHSGWRGSAGVAGRALRARRRGGLSWVSGSVSARRRTGFSSIRTIVLRLATDNKREPSSPPPYPVHFARPVLMSKIIGIIVVFASVLGGFLLSGGKIGAIIQPFEVLIIGGAALGAFLQSNPGSTFMVVLKKAPKMFSNRFTQTYYLEVLGMLYEILNKSRREGMMAIEADIEDPAASPIFSKYPGVLKDERMTAYVCDYLRIMSSGNMAPHELEGLFDMELSSLKEDLEHPSHAVTKVADALPGFGIVAAVLGIVITMALLGEGSQAEIGHHVAAALVGTFLGILAAYGFVGPLAGALEHDAKEELNLFEAIKACLVASASGMPPSLAVEFGRKVLLPAHRPTFAELEQAVRGR

SEQ ID NO: 32896 - protein, 265 aa, Pseudomonas aeruginosa
AHAQAGRLLPLPQPRRLHPQGAGCALGAAGPRELQEGQHPPGAGRYPRVDRRAAPLSRPLHQALIRPGRAVGAGWARFPRGAAGPIPRARGPAPKGTRGAPSAPPAPGWSRARCPAPPPGCATSARSRRGAAANPRCGRGTPPRSRGTVRRVRRCPGCGAAESRPARWGGRSDSMGRRSGSRRSRIPGCRSVAAAPAESRPCTRWSGRRCSVARPAGRGRRRPRSGRCPGRPSSVRNARCPSPGRRVAACRRTARRGRSSCRPCG

SEQ ID NO: 32897 - protein, 225 aa, Pseudomonas aeruginosa
FCQTARLTPNRSDDHDLPARRPATRPLFRRPGARPGCAPDRCRHAGLRTHAARRPRRLACLAPPLAGGRGADGARRGRQQCWRRLPDRGAGATCGLASAGAGGRGAAAACRRRGAGACRRAGDRGRGGALERVRRARGRSSGCIARHRPGRCRARALCAGHPPGQRRRPAGAGGGYSFRLERRHRRGIGGSDQGGSDRDFHRPEDRAVHWRCAGTGRRAGVRRTR

SEQ ID NO: 32898 - protein, 228 aa, Pseudomonas aeruginosa
RRRRAASAPAPGSPPGAKCPCRGWQRGRGPHTRGCSATCWWSAATPAWAGPCYWPPESAPALRRPGWSRRRPAVEHVPGVVEPLSRGHGPWRGVGEPTAGPLPNAPACCCSVPVLASAPWGRSPAERCPVATVAAGLGCRRVEPAGPGTGRSRAADMDSDAASRRGRAPVGSLDRRGAGGSPGGGAGTGVSLPGGGGAEGRRQPGRRAGRTTCRLFPGASGDGWCRPG

SEQ ID NO: 32899 - protein, 661 aa, Pseudomonas aeruginosa
AARRPGAWTGGDRSHTYRSSVARGVQSVSEVILSAEGEDAMLELGGRIARASGGQGVIYLHGDLGAGKTTLSRGILRGLGHAGSVKSPTFTLVEPYEIGELRAYHFDLYRLADAEELEFFGIRDYFDGSALCLIEWPERGAGVLPTADLDITITAQAGGRTLRLVPHGARGRSLVCHPDHGSMRKTMGWGLRLRTLLTGVMILLACQVGEVLAAAQIKSVRIWRAPDNTRLVFDLSGPVQHSLFTLAAPNRIVIDVSGAQLATQLNGLKLGNTPITAVRSAQRTPNDLRMVLDLSAQVTPKSFVLPPNQQYGNRLVVDLYDQGADLTPDVPATPTPSVPVTPVTPTQPVAKLPLPTKGGTRDIVIAIDAGHGGEDPGALGPGGLHEKNITLSIARELQRQINQVRGYRAELTRTGDYFIPLRKRTEIARKKGADLFVSIHADAAPSRSAFGASVFALSDRGATSETARWLADSENRSDLIGGDGSVSLGDKDQMLAGVLLDLSMTATLSSSLDVGHKVLTNVGRITSLHKRRVEQAGFMVLKSPDIPSILVETGFISNVNESRKLASASHQQALARSITSGIRQYFQQSPPPGTYIASLRAQGKLSMGPREHVVRPGETLAMIAQRYEVSMAALRSSNSLSSDNLKVGQALSIPSTALAAQ

SEQ ID NO: 32900 - protein, 146 aa, Pseudomonas aeruginosa
PRVPPTPAKPGRWKPRAATCSRGYSRRRTRWGPASRFATCSSTPRRGASSCVPRRPSSTICRRSSSAWRWPASTWLSTCATTARPSSPCTRRETSWPARAGSARCAARHSSSRRCRSRSSATACTCGAGSACRPSPAASRTCSTSM

SEQ ID NO: 32901 - protein, 219 aa, Pseudomonas aeruginosa
PSRVRPALPPASSARRARCAWPRACWRVRRHGWAGVAAHRPPAAPPAIPPIPGRRRRPLWPRPVAPTRPTSRRYPRARRQPRCPRAPRTSRRWVTPWRSSRASTFSPRTPTAWCWWTCTRPTSGSPTSASRWRWPAKACVGSRCWCRSRSRSASARRIARKSIPAGSSAWASSCSAWGRKAWRSGRSLRCSSRRRRPSWCAMSSPTCWNTAPATVSRRT

SEQ ID NO: 32902 - protein, 259 aa, Pseudomonas aeruginosa
SISAIRRRAIRPRNSAPTPWRRWPRPPRAAGFPCWWGAPCSITRRWLEGLADMPGADPEVRAAIEAEALSKGWDALHRQLAEVDPESAARIHPNDPQRLMRALEVYRLGGVSMSDLRRRQSAEKADFDASGRNQLPYTVAQLAIAPEQRQVLHARIAQRFRQMLEQGFIAEVEALHARSDLHAGLPSIRAVGYRQVWDYLDGKLSYAEMTERGIIATRQLAKRQFTWLRSWSHLHWMDSLAGDNLPRALKYLKTVSILA

SEQ ID NO: 32903 - protein, 117 aa, Pseudomonas aeruginosa
DLNLSVCFRNDSGVWTAPSHPIRLLQTTILKGVRHMSKGHSLQDPYLNTLRKERVPVSIYLVNGIKLQGQIESFDQFVILLKNTVSQMVYKHAISTVVPSRPVRLPSGDQPAEPGNA

SEQ ID NO: 32904 - protein, 437 aa, Pseudomonas aeruginosa
RESALFFERPGGGEQAVLVHLEGQNPEAREDPQEFQELVRSAGAETVAFVSVSRHQPSAKYLIGSGKVEELHDLVKAENVELVIFNHTLTPSQERNLERAFECRVLDRTGLILDIFAQRARTHEGKLQVELAQLEHMSTRLVRGWTHLERQKGGIGLRGPGETQLETDRRLLRVRIRQIKQRLEKVRSQREQARRGRKRADIPAVSLVGYTNAGKSTLFNSLTASEVYAANQLFATLDPTLRRLQLDDLGPVVLADTVGFIRHLPHKLVEAFRATLEESSNADLLLHVIDAYEPERDAQVEQVLAVLGEIGANELPMLEVYNKVDLLPSVEPHIQRDDSGKPVRVWLSAQTGEGLDLLRQAIAELLGEDLFVGTLRLPQRLGRLRAQLFELGAVQSEAHDEEGCTLLQVRLPRAELNRLASRAGWQPAEFVAQHTLQ

SEQ ID NO: 32905 - protein, 330 aa, Pseudomonas aeruginosa
RRARYGGRCFRRWWQRQRFRPGVADRQRSAPARRAYEGEPLMGNKSLIALIVGVVAAIVLWNSVYVVQQTERAVMLRFGRVVESDVKPGLHFKIPYVNQVRKFDARLLTLDAPTQRFLTLEKKAVMVDAYAKWRVADAERFYTATSGLKQIADERLSRRLEAGLRDQFGKRTLHEVVSGERDALMGDITASLNRMAQKELGIEVIDVRVKAIDLPKEVNRSVFERMSTEREREAREHRAKGRELAEGIRADADRQRRVIVAEAYRESEETRGDGDSKAAAIYAKAYNQDPEFYSFYRSLKAYRESFAEKRDVLVLDPSSEFFRYLNKANK

SEQ ID NO: 32906 - protein, 399 aa, Pseudomonas aeruginosa
KGRGEMATVDRWLLPDGIEEVLPPEAARIEAARRQVLDLFHRWGYEFVVTPHIEYLESLLTGAGQDLDLRTFKVTDPASGRLMGFRADITPQVARMDAHSLRREGPSRLCYAGSVLHAQPRALSTSRSPIQLGAELYGDPSPASDVEVISLMLEMLEMAEVPDVHMDLGHVGIYRGLARAAGLSGEVEQQLFDALQRKAVDEVEALTADLPAELRGMLRALAELCGGRDALEQGRARLAAAPADVQVALNELIEIADSLAGRFPGLPLYFDLGELRGYHYHTGVVFAAFVPGVGQSIAQGGRYDDIGADFGRARPATGFSTDLKSLVTLGQARLDQAVSGIWAPAEGAGLWQAVQRLRRDGQRVVQALPGQDAASAREAGCDRQLALRDGNWQVAPLAS

SEQ ID NO: 32907 - protein, 447 aa, Pseudomonas aeruginosa
DSAGRGRHRTSTMGTSVMGKNVVVLGTQWGDEGKGKIVDLLTEQAAAVVRYQGGHNAGHTLVIDGEKTVLHLIPSGILREGVQCLIGNGVVLAPDALLREITKLEEKGVPVRERLRISPSCPLILSYHVALDQAREKARGEAKIGTTGRGIGPAYEDKVARRGLRVGDLFHRERFAAKLGELLDYHNFVLQHYYKEPAIDFQKTLDEAMEYAELLKPMMADVAATLHDLRKHGKDIMFEGAQGSLLDIDHGTYPYVTSSNTTAGGTATGSGFGPLYLDYVLGITKAYTTRVGSGPFPTELFDDVGAYLAKRGHEFGATTGRARRCGWFDAVILRRAIEINSISGLCLTKLDVLDGLDVVRLCVGYKNADGDVLEAPTDADRYIGLQPVYEEMPGWSESTVGAKTLEELPANARAYIKRVEELVGAPIDIISTGPDRNETIILRHPFA

SEQ ID NO: 32908 - protein, 346 aa, Pseudomonas aeruginosa
SAGPGAHRAGRRVPYSGRAARSARTRRVGGRRPPGRGRGSQPQPGLGRKHARGTARAERGRAAAAGPGWRHRSAQPRRLPAYRRCGGGAGGDRAQGQVRDPQRHRAQGRLRRRRGDPAGGGDQPRAHPGKAPAARPVGGRHRWRGGQDPLPARPQGADRAGDGRGRQGHAPADPRALRLPRQVADGRQRQQPERLGRHRRLPVRDPPPAHPAGVSACGAAAARPRAIPSAVQIFANLPCFAGCPSLECRPLPRGQAFVRLSTRQAKKTFTPCLTVLRQAATRKEHLCVITKSCSWFTRTRANKSVAWSSVTPRPSKKTAARSTVWKTGAVVSWPTPSTTCTRPTTF

SEQ ID NO: 32909 - protein, 172 aa, Pseudomonas aeruginosa
VSDPIGRAGRAYACPRQSANIGHGTGNGTVPVVFSAVPFSCVESMNEITSPEQYDLETTALKVPPHSIEAEQAVLGGLMLDNNAWERVSDSVSDGDFYRHDHRLIFRAIYKLAEANQPIDVVTLSGAVGEGRTTGPGRRAWPISANWRRTFPRSPTSRPTRRSSASAPPCAN

SEQ ID NO: 32910 - protein, 469 aa, Pseudomonas aeruginosa
SCSSTATRCTTRRPSSRASPKSSSASSVTVRSVRCAWPSSANTRASRILPPACTTSRTNDPAWVLPGGRLTIGTRFSCRTRCHASPRCHRRPFRHSPQLCPGQALRAAAPGVRGGQGERLWPRCARSGYRVARRCRWLRRGLPGGGRGSPRLARQRAHPVAGRLLRGERIRPRRAIAPGPGDPGRGTGRGVPRRRPGYSTQRLAQARLRHAPPGLRSCRAARLACAPAQPSWCARAEPDQPFRLRRRTQPSAHRAAAGEFPRPARPGFRPAQPGQFGGGADYPGRPHGLAAAGNHALRVDPAGRPERRRTGPEAGHEPGRAVDFTARGGRGRERRLRRHLDRRAAGADRHGQLRLRRRLSAYRASRDSGTGRGTPRDPGRAGLDGHAGGRPLRPAGGSRWRPGGVVGRRVVGGRGRPCLRHPWLRASEQGHGSGSATLQPLIQEIRSGARAVGQGSAGAVSRSSSAAIA

SEQ ID NO: 32911 - protein, 150 aa, Pseudomonas aeruginosa
AWSRPSAKGTASPLRCSRNPPRSSGRYRRRSCRLALATSSHQPPDTASRLGRSRRSHQALRLRPTLVRPAAATKRPACSACSRSSTARLPSGSSSRSSEPFNQAPLAGGAGNSGAARETALASSRKMTASRARGWRTMTLPGACLRGRVR

SEQ ID NO: 32912 - protein, 672 aa, Pseudomonas aeruginosa
HDDRQRRYREDQRALGDGVPVRLRLRHQDSRGHRLLGDRSLADRLRRRHGAEIPRAAKGRSHRAALRGFVHHGDPERAAGGGHPRFLRHPDHQPGGADRGGRPGHRHGLVGIAGEPGGRRLHHRPAAVQGRRLHLRRRSDRHGQGDRPVHHGDQHSGQRADHGRQQQDIRRQHPELHPQPVPPGRVEGAAFRCRRLPGGHRPAQAARRGDSQRARRAAGGRGDPRVQPGRAGAGGAPVLPQRPLLAGLFRYQQGDQGRPRRRLPGTDAGADGDRAAVRRRLTFPARHRRPVLRGVGVCARTGWRAARRKRAIGESNGHPGEQGIVRACNRRRSRPGFIGKRIPCVLQIALDRRPAGGIRVQLQGSRPGGVGAEGRARRVSRQARRHPLFDRHPARLELQGPGARQRHPPALRGQGRPGSALRRAQVDLRRQQPLLVEQPCAQAAASAAVGDPARLAVADEGAGDPPLLKFRQAQQGHPHRRHPGPAGTGLAGRQGGVRGEQHAWLRQPGDHPARYLVHQHLRAQQPLAGEGGADGQQGPEDRRGRFLGCRPGATVLRDPPERPAARPAEPAAAVLREERITAGCGRPTSAPRLASRRRGNRAVPPGWHRAAACRGVRRGRSVRRPGGRGRSAADRRNRSLRAGPAAWRGSPVGPRSRPRTALPGCRARRAGR

SEQ ID NO: 32913 - protein, 192 aa, Pseudomonas aeruginosa
TPGRSRSMPRHVRFGFDLNQWNSVPDRAVCSFRIHRPTCLGGCSMLRKLAAVSLLSLLSAPLLAAECSVDIQGNDQMQFNTNAITVDKSCKQFTVNLSHPGNLPKNVMGHNWVLSTAADMQGVVTDGMASGLDKDYLKPDDSRVIAHTKLIGSGEKDSVTFDVSKLKEGEQYMFFCTFPGHSALMKGTLTLK

SEQ ID NO: 32914 - protein, 316 aa, Pseudomonas aeruginosa
RPGCDRHIPARDKGPSTTGLPHGPGGSGRLRQFALVLGLVVGVDDHPRSFLAQRLAVQEGVDLGIGDAVGSLVRMAGAQVLEVGGGDLLHQVLRSAEGAGEGAHLMLGQAAERSQVAGAVAELGEEPHDRLGGMVGADHQAAAGAGDGVLGDHADARLDIADDEVALRRLESFQGFQLFRQGFHRRTDVDGLLFVGADGRQRGLGIGLVLLHLVGQAHGDEAVGLVAGLLAQLLDGALGQQAGGERVDAAADPQHQGLQPGILQALLDEGDAPGDLRLHVGLRLERRLDLQGLGDVALDLLHVRAPVRCERIRPAR

SEQ ID NO: 32915 - protein, 251 aa, Pseudomonas aeruginosa
RTNCTAMAANARRAEERSDDEFSGSIGQRGYRGVAPEPRARTGAVADPPRPGAFRRPVGLARRAGQRPQRRPQPLRHGGAPPCATRRGLEPAYIEQVPTVGNAVRDPRGWSLSVFYLVLVGPDTRMEDDDLDFVPLRDVRSERFALPFDHAQLVQQACERLASKSVYSALPLFLLAPRFTVAEALKAFECAIGQEVQHSSLRGRLERMKEAGWVEDTGERQRPPMGRPQHVLHFTPKPGGAFVFDRSLLAS

SEQ ID NO: 32916 - protein, 184 aa, Pseudomonas aeruginosa
LRAPTSSSGATPHVQEAVQKRHPGSRGFIRDGSFHACAGRRRDRRGRTAYRRQRLLRRAILARRVPGGGRHQRGGWDQRREDQAGQGRRRLRTEAGRGRGQPPGGPGQGHRRGRPFLLFFDHPRIRGLRRGRDHRHHPRFHQPAGHRARTLRDVPHVRPRRPAGRGRRRLYRQRAQGQEGRGDP

SEQ ID NO: 32917 - protein, 334 aa, Pseudomonas aeruginosa
HPSAFTGERRRALQRPSRFALKRLKNGRHLPPANDQRADPRLGLRPHRHRLHHGLRHHRHDQLRPRRGVHDLRLPVGHRPCPAGLLRPAELPAADPRHLAVHRAGDLHLRLGDRAHRLQAAAQLHAPGAADLGDRHVADPAELRAGGAGTAPAGDPDPARRRPEIPRRRRFRPAHLHQAVHPDRFADRHGGADLRDPLHQARAHVPGDPAGPQDGFDPGDQHRPGDLLRVRHRRSDGRPGRGADHHELRHLRLLRRLHHRHQGVHRGGARRHRLAARGDARRPGAGSGRGAVLGDGQHRLQGRVRLLVAGTDPDLPSPGPARPPADRQGVRGRR

SEQ ID NO: 32918 - protein, 257 aa, Pseudomonas aeruginosa
SASAGWASPRARGWRHERQDPQRRAPDDALRRHQGAQRRQPRRRARFDHRADRPQRRRQDHRVQLSHRLLQGHRRQHPAQHPGAHHGRHPGARRAVPAGRLRQAAATGQSPLLQDVRRHPPGEPRRAGADLPEHPPVQGHVGGGEPAGGAAHVRQPQPARRHPQHSRLSPRRERGAGPRVLLAGGGRPGGLRQPPGRRDVLRPAAAPGDRPGHVHAAGTHLPGRTGRRPQPGRDPRPEQHRPLPARPPRDHRTADRA

SEQ ID NO: 32919 - protein, 254 aa, Pseudomonas aeruginosa
REGDRRLSRCRRKGAVMSAALLEFREVDVFYGPIQALKKVSLQVNEGETVSLIGANGAGKSTLLMSIFGQPRAAAGQILYRGQDIRQKSAHYVASNGIAQSPEGRRVFPDMSVEENLLMGTIPIGMDHAEEDMQRMFELFPRLKERRNQRAMTMSGGEQQMLAIARALMSRPKLLLLDEPSLGLAPIVVKQIFQTLRELARSGMTIFLVEQNANHALKLSDRAYVMVTGEIRMSGSGEELLGNQEVRNAYLGGH

SEQ ID NO: 32920 - protein, 248 aa, Pseudomonas aeruginosa
  UNSURE (216): Identity of amino acid at the above locations are unknown.
GDRRETGDGVPWQWGAWPAGGGRGVRSVRRRRRSPAGVAGGFGADRPAYRLQLGAGRRLPGAGRCAAPAGGRLRNPGCAHGAGPRLRARLSPHRHLGPRSGQGRRAGRPAARGGLPGASGRRVARGGGGGRLRQLRYHLPRSAGARRMAEAGRPSRPGRRLPAVHARDRRPGGGARAGRGGYPRRRAGRSRRPVAGDRRRRHRARGDIHRTARLAXRGRAARRSRGNHPVQVGGLCAGGPGPRAPGCG

SEQ ID NO: 32921 - protein, 279 aa, Pseudomonas aeruginosa
  UNSURE (7): Identity of amino acid at the above locations are unknown.
RTGHLRXAAAVRQRHPGDQPARLQLRVFQRLGERQQRLHAGIQGGEHRLPFGEVAFLALIVALANMGMNVTPLLAGAGVIGLAIGFGAQSLVADLITGLFIIIEDSLSIDDYVDVGGHLGTVEGLTIRTVRLRDLDGVVHTIPFSEIKSIKNYSRQFGYAMFRWPVPASMPIDDAVALVREVAMELRSDPAVYRNLWSPMELQGVESFDNGQAILRFRFKTAPIKQWEVQRAFNLRLRRRLDQAGLELSMPRLNVQLSRAPKAKSAEPDEPGTPADGGI

SEQ ID NO: 32922 - protein, 499 aa, Pseudomonas aeruginosa
YRSYSSGVHEGAHLDLFFALQLDVGIDELVGEHAALGQERAALVELFQRLFQAAANLRDFLRLFRRQVVQVLVGGIAGVDLVLDAVQAGHQQRGEGQVGVGCRVREARFDTAGLRAGYVGDTDRGGTVARRVGQHHRSFEARDQALVGVGRGVGEAVQGLAVLDDAADEVQGGLGQAGIAFAGEGVLAVLGDRHVHVHARTVVAVQRLRHEGHGLAVGVGDVVHAVLQGLHFVGLGDQGVELHADLVLAGGCHFVVVDFDHQAHFFQGVAHGGADFMVVVDRRYREVAALHARAMALVAGLDVGVGVPGSLLGEDLEHRAGDVGLELHFVEDEELRLRADEHGVADAGGLQVLLGALGDVARVALVALHGARLDDVADQDQGRLFGERIEDGGAVVRHQDHVGGFDAFPAGDGGAVEHLAGFEELIVQRVASRHGDVLLLALGIGEAQVYPLHVMVFDQLVRLVRHAVLQEGLELGAFSVPQYRVMPAGILRQGNLPHK

SEQ ID NO: 32923 - protein, 499 aa, Pseudomonas aeruginosa
FRPFFSVAPRVRVPRMKLIVKTFQEITIKSRPVRKRFIRQLAKNIRAVLRDLDPELKVEGEWDNLEVETAVVDAKARREMIERLTCTPGIGHFLEVHEYPLGDFDDILAKCKAHFGDQLAGKTFAVRCKRAGKHAFTSMEVERYVGSGLRRECGAAGIDLKQPEVEVRMEIRLDRLFVIHRQHPGLGGYPLGALEQVLVLMSGGFDSTVAAYQMMRRGMISHFVFFNLGGRAHELGVMEVAHYLWEKYGRSQRVLFVSVPFEEVVGEILTKVDDSYMGVTLKRMMLRAASRVAERLELDALVTGEAISQVSSQTLPNLSVIDRVTDTLVLRPLIVSHKQDIIDTARQIGTAEFARHMPEYCGVISVNPTTQAKPYRVEHEESKFDMAVLERALERATQRTVDRVIDELGQDLQVEEVGEVLPGQIVIDIRHPDAQEDEPLALEGVEVQALPFYAINSRFKELDANRQYLLYCDKGVMSRLHAHHLLNEGHTNVRVYRPA

SEQ ID NO: 32924 - protein, 677 aa, Pseudomonas aeruginosa
AAGLVRRQHPPPSSRHVRRLGRCPPFGVPAGPGQRPPAARPLIEEACRVGRRPVRPHHRREAALRALNETRLVIENLRNIAIIAHVDHGKTTLVDKLLKLSGTLDRKEAESERVMDSNDQEKERGITILAKNTAIKWNGYNINIVDTPGHADFGGEVERVMSMVDSVLLVVDAQDGPMPQTRFVTQKAFKAGLRPIVVVNKIDRPGARPDWVIDQIFDLFDNLGATDEQLDFPIVYASALNGIAGLDHEKMDDNMDALFQAIIDHVPAPVVDTEGPFQMQISQLDYNSFLGVIGIGRITRGKVKSNTPVVAISDDGSKRNGRILKIMGHHGLQRVEVAEAEAGDIVCVSGMEELFISDTLCDPQNVEALPPLTVDQPTVSMTFQVNDSPFAGREGKFVTSRNIKERLEKELLHNVALRVEPGDSPEKFKVSGRGELHLSVLIETMRREGFELAVGRPEVVIIEKDGEKQEPYENVTIDIEEQHQGSVMEQMGLRKGDLSNMIPDGKGRVRLEYTIPARGLIGFRNNFLTLTSGTGILTSTFSHYGPIKAGEVSNRQNGVLVSMATGTALTYSLETLQSRGKLFLGPGDEIYEGQLAGINSRDNDLVINPTKGKKLDNMRASGKDEVIALVPPIRFTLEQALEFIADDELVEVTPKSIRLRKKMLNENDRKRYERSKV

SEQ ID NO: 32925 - protein, 147 aa, Pseudomonas aeruginosa
TVAVPARRNGVPRGRQAGQGCPACRPFCYAPGAFRRGLMAPAAAARSKRRNVGQSMCSRAGQAAACRRPSRMAARRRIVRSSSSALAASAARSIRSAPSAAPMPAISSSDNPAARPSPISASRSSTPASNSRRRPCRPLEAISPFSS

SEQ ID NO: 32926 - protein, 172 aa, Pseudomonas aeruginosa
RFGTWAVTKYRRGEPHVGQTLCRRRVCLRNRTQRFPEGACAAAGRAGAERRRGRGAQRGVPRFAGAGGAWRGRLHRRPGQGAPAGRGERRVDRHPGGRPGGLRTAGSGVRRGGVDLRAPAQSRARQTQPPAGAFAATGRSLPAGGLSAGTTRPRHRRPGGRRHAGEPCGAGG

SEQ ID NO: 32927 - protein, 396 aa, Pseudomonas aeruginosa
RPASAAPCRPSSVSTRTLAGRAWLRRGQGLAVRRQHGIAHRRGAAVHRPGLPPALCLGTGGGAGGVPLRRGGAGSDGAARRRLVAARAARRLRPDPARHRYRGAVPDHLRRHAPASADLSRRGAGPAGGGDDLLGDPRRAAERHGPGGGGGARRLRRADPDLHRQRQPCSAVQLLRPAQRRHLRHRLVPRLAAAQPGRLRRHLRHRLRLGTALLYTGAVRQHRAVPGPVLPDVRRDRPALRPPQAAGGRAGACRARRTAALVGATGRLHRRHRAVRPATGGVRPAMRGDRPHRLRHGLQRPGPGALLHGPGAGAARPCFGRTHQPAGGNLPGAGGGLRHPGHSARPGRALDLGRLGRRGRRHLLARPAPATPPGAALRPAVAGRCGVGLPEWRAPG

SEQ ID NO: 32928 - protein, 454 aa, Pseudomonas aeruginosa
RAGPAAGRRALHRGLAVARPGPDPGYLRWSLAAFRQPTQRHVQRRADRPVEPGRRQRHSVEHPAAAQGRHGQPGFLRPGRRPEPDRHLFQRQRLYHEPDLRDQRQHARPEQTAVQRQRAPDHHRPAPDRRLHLFAAVGALGVDPAAGNGPRHPACLPGRTAQPVAGGLGELAERRPVARLRRRRRPAPGLRLPGQRRQRRRQWLQPDPWRQLPHRRGLARRGRRRFLPAEAGSRRQGFRLPNEQLHGQRLRAVPGNPLVGRRGVDRRLPRLRRPEAQVRPGRRRAQRERRHQRPPVGVQRAPGLRHRPAGRQSLAPVAVRQRRLCTGRGRRLFREGRQRHRARLRRPEAQLEAPGRRPARQVRVRQRYSAVRRVRPRTRVRGRHPGPHHVPQQPAGQSLYPRRLHPAGPPQPRLPRLQPEAGTGAVAARRLQLAQGRGRYPAERQPGAEPGLLR

SEQ ID NO: 32929 - protein, 258 aa, Pseudomonas aeruginosa
CTKPTRCRSSSSRPAAPPPTAPSASSTSSRRTCTSVSRCSSARSRKSSASPATTRSRPMSAPWETLLDWWFGTSSDAAEVVAQRNGLWFGKNVCQDADAGGRFGDLVNQALDGGLQEWTAEADGWLALILLLDQLPRMIYRDTPRAYAGDARAQRVVREGLEKGFDRQLPPVRRVFAYLVLEHAEDLPSQERAVACFRDLRDQVGGSVRKPFDDFYDYAERHHAVVARFGRFPHRNAILGRPSSEEETAFLREPGSRF

SEQ ID NO: 32930 - protein, 109 aa, Pseudomonas aeruginosa
LQGSGFPPRVPSCRAALPPNKEFLMASFRTLAVVAFCVVLAACSKINQENYSKLKAGMSKAEVEAILGKPTECSGALGMSSCTWGDEKAFISVQYAADKALLFSGQGLK

SEQ ID NO: 32931 - protein, 954 aa, Pseudomonas aeruginosa
RPTARTSGADKRNAVVRRCAGSVEQFPQHLDECPCAALFPCMPAVAHHPSAGHHHVAHLAVAAGEQPAVEQGVALGAGQVGVVAVEHQQVGATAHGETTDRLPKGLGAASQSSVVERAADHRLVVAVQPVAFPVAQALAVFQPAEFLDHAERDVAVRADAQAPALGEEVRRREYAVAEVGLGAQAQAGHRAATRHRRHLGGVGVGRMDQAPALVDRDVLVQPLQRPASAPGLAVVDFLLLFGDMDVDRQVVVAGGEDRGDLLRSHRAQGVEAQAQGVACRLQRRAQALEQFQVGLAAIDEAPLALAGRLAAEACVTVKHGQQGQADTCGAGGAGDAQGKFGGVGVGAAVEVVMDVVEFRHRGVAGLEHLDVELAGDDLDLFRRQSSDHPVHQLAPGPETVVGIAGDFGEPGHGALERVRMEVGHPRQHGAAEAFGAVGVGVGTNPGEDSVRGNLETDISRPAFRQQRTFSENCGHNQLTCSLFYLYIHIQTIKRCVNSLHRRLDKESLRDVLFLRSFPAGLATRRGTGAALRAGQADDRQPDPVGRLAAAPPGAVRERTGQPARLQSHDHQSRPARTDQRRPAGAHAGGRNLRRRAQGPVGAVRGAQHRRRDRGPRASPSLPGDHPRRGGRRPRARPGTGRARRPAGVPLADRALRERYPGADRGPLRERRGGAGLPQAGFHPANALCLPDPGGAAHRGRACGRGDPRRAGRVQAVADRTRRAVPADPPPHMVRACRGDRRAAAAPGFPPPSGRTFQLMSELRILRAVDYPRMPWKNGAGSTEEIARDGGDGLDGFGWRLSIADVGESGGFSRFAGYQRIISVLEGGGMRLRVDGAESAPLRARQAFAFSGDSEVHCTLLDGAIRDFNLIYAPQRHRARLQWLRVEGELDWHGTASTLLLFAQQDGVAISLQGQPRGQLAAHDCLCAEGLQGLQHWRLTAHEPAWVCAVELDSL

SEQ ID NO: 32932 - protein, 352 aa, Pseudomonas aeruginosa
FRMPSDSNRETRMPPLRQILAVLALGASLASQTAVAAECPYPGKVVFAGLNWESGMFTTDLLRYVLEKGYGCETDALPGNTVTMENALRQNDIQVTGEQWAGRSPVWRAAEEAGEVFSVGETVKGATEGWWVPEYLVKGDPQRGIEAKAPELRSVADLPRYKALFRDPEEPAKGRFYNCPTGWTCEIVNSQKLKAYRLQDSYTNFRTGTGPALDAAISAAFRRGEPVLFYYWSPTPLMGRFKLVQLEEPPFSEKAWATLSDPKNPDPIGSRSLPAKITIGVSRDFHDKAPALVELFRKVEIPLPLFNELLADMAQNHREVGEVRAQFLRQHREIWSHWVPAEVAARLDTSLK

SEQ ID NO: 32933 - protein, 171 aa, Pseudomonas aeruginosa
QPLAAPPRRATDLPGAGPRESLRQSVRVAAPGLLAAALALPGQDPAWSRHPRPAAGPGGDGAPGGFAVAPGRGRRLAPVGPACRAAGRVAGRALALGGHPALAVPAGGGLSGPRPEHAALFLRAPSGPRAGAAQRAGRGGVAVAAAVPQQQLASGPPRSAGPALVPAAARV

SEQ ID NO: 32934 - protein, 188 aa, Pseudomonas aeruginosa
TSSASRAASTSACAVATSTSRPRTWTTPWRGSSATPPKARPSPSPCWAMPPRSFRNWFAAAYARTWSPTRPAPTIHSTATCRPAGAGKSTATARRPTRPPWSRPPSSPWRYTCGPCWRSSSRACRPSTMATTSARWPRKRGWPMPSISPASSRPTSARCSVAASVRSAGPRCRATRRTSTRPTPRSSN

SEQ ID NO: 32935 - protein, 424 aa, Pseudomonas aeruginosa
SPPSADLENRLHAGGAWGRPPTVPTRPQQEWRRASRSGVQQHDPGQRQQATDRTALDRLHPGERAPRPPLQPVHPLAGGQPADHRHRHRRPRRGPRRRRVLVAGRPAHRPAPRRRGDGPARRAGAAPGAAADDFQPGAVRRLRRLHPDRTGVPDVPGLHRHRHGAFRPGHRPAHRAQRQHRDLHLRRLHRPGDGARLSRHPHHRADRQRPRHHRLRLPVQPPDAAQRHRRPARHPPFQLGLVPPRGVAGGVLADRLRPLRGRLFTLPAGVHLVVEDLPRRRPRLGARRPGLDGPRGVLRSPGQRPVRRPRGGLHRRPGQQRDRRRAALLQHRLRQGDHFHAELLRQLHVHRDHHQQRTRPTGDHPRATPVLRPRDRRRLDAHRAARPALVPRCVQVLHPVPADLLHPVERGEPGRLLLHHPRAL

SEQ ID NO: 32936 - protein, 501 aa, Pseudomonas aeruginosa
TRCCRPGCCRVFDTRPRPLGRGAPARTTRGEPRDDARHGASARTERPSYSFHGTGVGDRHRPVLRFRIGHPDGRAGGAAGLPGRRRGGVHGDARARRDGSARAGVRLVRPLRQQLSRPPGRVRHRLDLRFRDDHRLPRRCHRVRHLHGVLVSRRAALDLGTVHRAVHRRAEPLSCQGLRRAGVLAVAGQGRCHLRDDSPRARHLVLRLQLGRRRRLPPPACTTFGSTAGSCPTAGPGLVASLSLVVFAFGGIEIFGITAGEAQDPQRVIPRAINAVPLRIRLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRIGPRQVAALKFPVPLWPFAPATAIVFMLFIFVVLGYFPDTRPALWVGAIWIALLVIAYRRWVRPKGDAAHGVLQAQGGL

SEQ ID NO: 32937 - protein, 361 aa, Pseudomonas aeruginosa
RNRRRPGPPANNNDRGRSPGRGPQVFQLPFPIVHLERRTMRYKKSMLSVLCALGLLAAAAGAQAEGWCESGKAVKFAGLNWESGTLLTELMQFVLAKGYGCTTDSLPGNSITMEQALSTNDIQVFAEEWIGRSDAWNKAAAAGKVVGVGEPIVGAVEGWYVPRYVIEGDPQRKLEAKAPKLRSIADLAQYAEVFRDPEEPGKGRFYNCPAGWTCELENSEMLKSYGLEETFTNFRPGTGPALDAAVLSSYRRGEPILFYYWSPTPLMGRADLVRLEERPGVDKRIRIQVGLSRTFHDQAPELVAVLEKVNLPAELLNSDLARMAKDRIDAARLAREFLKEHPEVWHAWVDEDAAKKIEAAL

SEQ ID NO: 32938 - protein, 291 aa, Pseudomonas aeruginosa
THDRREQTMFPERLTFSIADWVNAWVDALVTNYGDLFRKISDTLLWAIVNLEGLLRATPWWLLLAIVAAIAWHATRRLLPTLVITGLLFLVGAVGLWDKLMQTLALMLVATFISVLIGIPLGILAARSNRLRAVLMPLLDIMQTMPSFVYLIPVLMLFGLGKVPAIFATVIYAAPPLIRLTDLGIRQVDSEVMEAVNAFGANRWQQLFGVQLPLALPSIMAGINQTTMMALSMVVIASMIGARGLGEDVLVGIQTLNVGKGLEAGLAIVILAVVIDRITQAYGRSRHETSK

SEQ ID NO: 32939 - protein, 320 aa, Pseudomonas aeruginosa
SRSARHGKSSTSRPTTTLTASSSGGWRTYERPTERRVRRRSAALAGTGRGGPARCAPGTVGGGLGTDRQRPRHRLPYRRQRRACLRHQYRPRRAVRRPAGRRAARRAVAQHLAQPCLRGRRAAARRTDPGDHLCRRRQLQPGQVRARPFAGGRTAGAAQPRHYPAGAGPGLGGLPDPHGARRHRPARHRRGQLPRQRRAGRRRVGGGRPGDGAPGSQGRALPGQRHAVHDRPRLPGPGRRAAPGAVGRRDRGDELRGPARPTGGVRRRDRCAQAASRDAAGRRQSASLAGWQPGTGERPRHPHPGCPEHPLDTADPWRLP

SEQ ID NO: 32940 - protein, 619 aa, Pseudomonas aeruginosa
PVGPRGAADRDRTQLGHRQPAAAGYAGSLPGGIPGQSPRRIGGDGRRPAGDRRGRAGRGRRAAPGSPGQPAGQRPAGVPGGQAGSQLGDDDHPVRRRLPGWREPPAGAAGGGRQLRHLGAPGGPPEPRHQCRAQAWQGPGEPPADPRHRVPAGRPGLRIPRPATLRPGHRGGLGHPARARARVRHRPLAGSRHRQRGGHPRRAEESRPAGREHRRPAMKRLWQHCHAATLKGGKYSIVEDAALVTDGPLIHWIGPRAELPPDDYAERIDLDGAWLTPGFIDCHTHAVFGGNRSGEFEQRLEGVSYAEIAAAGGGIASTVRATREASEEELLASARKRLEPLLRDGVTALEIKSGYGLDLASERKMLRVIRRLGERLPATVRSTCLAAHALPPEYAGRADDYIEHICSTMLPALAGEGLVDAVDAFCEHLAFSPAQVERVFIAARELGLPVKLHAEQLSSLHGSSLAARYRALSADHLEYMTEDDARAMGEAGTVAVLLPGAFYLLRETQLPPIDALRRHGVAMAIASDLNPGTSPALSLRLMLNMACTLFRLTPEEALAGVTLHAARALGLEASHGSLEVGKLADFVAWDIERPAELAYWLGGDLPKRVIRHAEEVYRG

SEQ ID NO: 32941 - protein, 184 aa, Pseudomonas aeruginosa
SVDALPPDHRRGTGAAEGRVRLRAALGRPLDPFPRAAPVRRPTARLQSRHQRRRQLRSSAGGPPGGGLRCRRRLQPCAQRALQGRPHHPPLRPAGAARPCRPAGAGAVHLHGRAGPVRLPRGPRRSDPRSHPRTAGKPPRLGSRALRLRCSEAADAWPVLADVKAADGVGRPRRHSGNFLLQIY

SEQ ID NO: 32942 - protein, 748 aa, Pseudomonas aeruginosa
AHAMSDLYKPQTLKLYAQQAGSVRLTLDWFANKAFYPPRAGVHIKPLINGQAAFDAVHAAMEAARHSIDIITWGFDPAMRFKRPDGPRIGELLQTKGREGVQARVLVWSNQLARLKENTIPGAGVGGSGGTWAGSGVASGSAVDNEVLRLEQRRQHNLNLIARQQEALERSERLHREGRLPSFDPRGAAHARARIAELEAENAEIQRTLDSSEAQGYGGKRGSGGTRQDPWGQIFTRDWFKAVRGGGLQNVEFRTRDFEQTARPVMNGEQVRLVNGRLQSLIHLLRADGIDDLGIGQLLVLTQFASHHQKMVLVDYGSPQAIGFVMGHNMHRNYWDTSAHLFDDRAAGRDPGFGPWQDISMQVQGPVLADLSRNFSEAWDLETPWYKRWFSTPSLTAERDALPLPKIATPTSNSVAQICRTQPQDDERSILEHYLKALGNATDYVYMENQYFRYAGFAERLRKTAQVRKARGVPGDLYLFVVTNTPDSSDASKTTYDMMKGLGQEQLMPQVQRDLAHDLREKREQLKQVRENLHPDPYVRRGQENNIERLERKIEALEEKGVTPEVEQRLGDLGAQEIPGLAKNTGEDDKPYQLVEVPGLKVVVATLATSDPAPGSPPPARLSAEAEAALGAPPLKARYKHIYVHSKLLLVDDLYTLLSSANINVRSMHGDSELGIAQPNPDLARAMREELWELHAQKVAATTEKNFKLWNQKMDANWRQQRKDEPLVANLLRFWDVVTPYSPGLTVD

SEQ ID NO: 32943 - protein, 293 aa, Pseudomonas aeruginosa
MMRPLCFFLLIFLLSGNPVMAAELRPFICVNEKDHLPSLDPQADAWYREAVALAKPDTLRPWDRIVDLYSKAVERGHWKAMHNLASLYRTGWPGGVEKDTQKALDLYQKMIDLKVPQGFYDMAAMIGNRAGVKNPATDGLTFLDKAASLGNPPALTELGRLYIYVAGQDELGLKYTNCAAGQGYAPANYELAMYYRLVAHNYPKAAGYYLLAASQGNDDAAFFMSGVFDKTSPDVDRMWYAPDEKLHKLYDGIYDQLAADPDLRFPNLIKDHPLPPHPTQGYDADRPDWKPGQ

SEQ ID NO: 32944 - protein, 99 aa, Pseudomonas aeruginosa
TWSAPRTTAKPSRCCNRVARWPSTWTMRCSTANAPRRASRTTGWWSASRNRGRSTAAWCARTTRSSLPWSTRPWPGCIARARYRASTSAGSSSRSRPRG

SEQ ID NO: 32945 - protein, 175 aa, Pseudomonas aeruginosa
TLRSPRAGRRRTACAVCRRKRFAGRTAGRLRPRRPRLRLRCPVASLLRSQPLPYRHLRPARLRPFHAPRQPGEEQHLGAGGGHGAPARAPGYREVGAVRRFLGLDPVAGLRADPSRAGPCADPARHLPLPSAGHPLVLPGRRQPPVPRLLGRLCRADPAGRARRPAGGLPQAPDR

SEQ ID NO: 32946 - protein, 283 aa, Pseudomonas aeruginosa
RPDRPDARRQGLVDLGGPHRHAAPQPHGGGPLHRAGQGAVDLAHREPLLRQPGLPQAQPVARGHAPHRPSAWRDRAWPLRRHLSAGQCLGPAPGLAEQRTADHPRRRAYRQRAGDSRCAGARHQRDRPATARPAAGGRMKALLQRVGAARVEVGGEIVGSIDRGLLVLVGVEPEDGERCAAKMLHKLLNYRVFGDDEGKMNRSLLDVQGGLLLVSQFTLAANTRSGLRPSFSSAAPPAQGEAVFEHLVKLAREAYPQVATGRFGADMQVHLVNDGPVTFLLES

SEQ ID NO: 32947 - protein, 541 aa, Pseudomonas aeruginosa
TVRASSVIHVHGRGGLVIFRSVSNTDFRARVRTLLLAGSTALAFVAAPVWAFSIDDVASKAKDLAGDKYSAPTSNLPSEFSEMKFADYQQIRFINERAYWGKLKTPFKLSFYHQGMHFDTPVKINEVTATTVKPIKYDRTKFDFGSLKFDENATKDLGYAGFRVLYPINKADKQDEIATFLGASYFRVVGKGQVYGLSARGLAIDTALPSGEEFPRFREFWIERPKAQDKQLVIYALLDSPRATGAYRFVLRPGKDAVMDVQARVFLRDKVSKLGLAPLTSMYLFGSNQPSEQHNFRPELHDSSGLQIHAGNGEWLWRPLNNPKHLSVSTFSVENPKGFGLLQRGREFSRYEDLDDRYDLRPSAWIEPKGDWGKGTVELVEIPTPDETNDNIVAFWNPETQPEVGKPLDFAYRLHWTMDEDELHDPKSSWVKQTMRSVGDVKQKNLIRQQDGSTALVVDFEGPALKDLAPDAPVTTQVSTDSNAEVVENSLRYNPVLKGWRLTLRIKVKDPKKPVEMRAALVDEAQKPLSETWSYQLPADE

SEQ ID NO: 32948 - protein, 143 aa, Pseudomonas aeruginosa
PLPDLRQQRRQRADRRRRPHGDRHADLQRRRAAGIRRPAGDRRVDGRHRRDGALRLLRPQRHQRPGYRRRRAAGLARAVPRDQGLRQDLLPSPPASGEAQERQHRRLLPALGRRLPLHGGDGRRQRDERRLPGQAGTPDGGQS

SEQ ID NO: 32949 - protein, 419 aa, Pseudomonas aeruginosa
GGDHPDRAEGVRHGHPVCAHAAVRHPRLRPAVHRRPALLATRRVALLGPQRDHPHAALHRPLRPGAVAGQGLVRRRDPVPRLRRGCVDAPCRLGRVDRLRPRRQLRRTAAEPARRTQARPPLVPRQPDELPPVPGQGHAPGAPRGVPHRGHVLPVGAVVVLLPGAFHRAAGGAPTDGAAVLPGTAAAVPDLAAVASGEGHRVVLHHPDPVVPAQAAQRNADLGQGRQGFRRGDPGDPEHAPGDVLLGAAGAGAHALPHPLRACRLPRLVGAVELAAARRRRHALERGDPPARHADSTGYRLDPAGGLAQPALPVVAVADRRFADPVDPGIGDLQPGEAGPARPRRKAVPDPGGVRHAARAARHRRVHLREPLACAQGWLPQGRRRSVAQRPGLRHGHGSPQPCASHRDGARRAYRQGHR

SEQ ID NO: 32950 - protein, 339 aa, Pseudomonas aeruginosa
RPPRRGPSYLRIPSFERVSVTKKKRSVWPWHLLTGLILLVLAWALWFSTSLISYEWRWNRVPQYFAYQAEEPLRANEIGRVEAIEEQGRDARVTLLGESGEKQVVTVAQDSLQFSEGDDVAEGDAVGVTRHWAAGPLLWGLWTTLWLSLVSGAIGLAIGLVAGLCRLSKNPTLHGLSTIYVELVRGTPLLVQIFIFYFFIGTVLNLSREFAGVAALALFTGAYVAEIIRAGVQSIARGQNEAARSLGLNAGQSMRYVILPQAFKRVLPPLAGQFISLVKDTSLVSVIAITELTKSGREAITTSFSTFEIWFCVAALYLLLNLPLSHMASRLERRLGQSD

SEQ ID NO: 32951 - protein, 245 aa, Pseudomonas aeruginosa
STQPAEGLRYPRPGSARGGRREYPRGQGRGTGGDRSVRFRQVDLPALPERPGGVRRRLGEHRRRRPGRPEDRHQCLPPRSRHGVPAFQPVPAHDRAREPLPGPTRGAQARQGRARGQGAGAAGQGRHRAEGRRISLAPVRRPAAARGDRSRVVHGPQGDAVRRTDLGARSGDGRRSPRRHEDPGRGRHDHGLRDPRDGLCPRSGRPRAVLRPRQAAGGRAAGAVLRQSAGPAGPGLPPPGPLVPR

SEQ ID NO: 32952 - protein, 785 aa, Pseudomonas aeruginosa
WSIPGVSRAKASSSISMVIGRMASSPKRRKPDPTQRCPSCPLSMDGRGCRCKEDPLGMLQAEASHLCLQLRAQARQLAAGGGGLLAGGGRLLGDVAYAEDAAVDLLGHRALLLRGSGDLQVHVLDVGDGAGDAVQRGARAARQFHRAGGQRAAVLQAFGGFAGALLETLDQALDLGGGLLGALGQAADLVGDHREAASGVAGACRFDGCVERQQVGLLGHRLDHVEDAADLLALVLQARHGFAGNVHFASQALDAGHRLVDHRVALARLFVGLASGLGSQFGVARDVLHGGGHLVHGGGDLVGLHFLAVDPGAGLLGDRREFLGGAGQLADAVADPPDQLAQAVAHALHDSLQLAQFVAALEGQGILRTLAEVAGGDGLGLREGFVQRPDDLPVDRPAGDAAEGQGQRGDQPEAGAVAAGGALAQLATGFGEGPAGPGHILGAALHRLLRLARADDAGTELLDPATIALEATHGLFQRRIGLAGQLATQRRGGLAEGVERGERGLLGLVAAFEDVAAHLVTHHEQLLVQVGHRTATLQRLRVAGLLREAGVHQFLEAGEAVQRLLCSAHQHTTGGAALLIGCGEVVESLAVGFDGFGLVGQGGRVELAVAQRLQALEHPGQGLADLLGLARVAAGFECQAALFGLLGLFHQAGDFGELLAEGGLVREGAVAADHHQQKQREEDTETDHQLAADAQLGQLENPPIVHRHYSRQCDTLGWQPHGVAEQVMAQRRRVRRAGAEGRYVAGGRGLMVVVRSPARQRMSAGRGKPSVFYRSFFRTTAQAGR

SEQ ID NO: 32953 - protein, 346 aa, Pseudomonas aeruginosa
GGDRAGPHDPPTRSRRRRGAAGSLAGGRRLVAVAGRLVVRMLAALAYQAAEQQADLEQQPHRHREHGLGEDVRRGQDHADHETADDHVRADLLQVLDVDHSDPDQQHRGHRDLEGDAEGEEQSQDEVQVAVDVRHHRHALGRHAGEEVEDHREHQEVGEGHPGVEQDDAGHQQRQRHAFLVLVQAGRDEAPDLREDHRHGEEQRHHHGQLERREERRGDVGGDHAGAFRKEAAQRLGDQGVDLLREVEQAGEDQEDRRHAAQQARTQFGQVRDQGHFLVVLGLLGFIGAHGLRGVSDGGEGGVEAATAGGAAASAGGTAGVLVGGGVGTLGAGLSAAGGGVSCGGF

SEQ ID NO: 32954 - protein, 285 aa, Pseudomonas aeruginosa
ELSGAAFLRSSSTAARRVRVSLMVVSCVFVDSVRVLQHRIDGLPGAILEDTVETAFPAGMAGDPADLLDHQDDHVGVAVQAQFVQLLHMPGLLALAPQLATRTRPIDCTVLAGGQGQRLAVHPGHHQHAPGLVILGDRRDQAVGVPVNLIQPVFHGLSTFVAGTLRAFPAEMGVVCQPGARLAIGAGLVAVRGASGAGSGTPRRPASPTPARLPAADPGRPRRRRPAAPRPPGARASRGGNLSTPAAAHCGRAVVTGVRGCRGPFATGAAPARPVAGNCAATASG

SEQ ID NO: 32955 - protein, 198 aa, Pseudomonas aeruginosa
ALDSRLLLGLENSSTSRRPPGLSTRSMERIASSLWVTLRRPKAMVTQSKWLSGKGSFSASAWTKLTLPETPLSSSLSRPTLSIEALMSASTTSPVGPTRRENCRVRSPVPAGDVEHAVPAAHAGQLDGEALPQAMDATGHQVVHQVVLGCHRVKYLGDLLRLLAFRNVLVAEVGGGFGVGAFAGIVHDVLTWKECRAF

SEQ ID NO: 32956 - protein, 124 aa, Pseudomonas aeruginosa
QDVGKVLCRRPTARVRCFVWPRIVFRSAIRSRSMSRIHIERPHSLGLDAARAKAEKLAERLAKEHGVQCEWQGDELTFKRSGVDGRIAVGADKVAVDVKLGLMLSAMSGLLKGEIEKALDKALA

SEQ ID NO: 32957 - protein, 316 aa, Pseudomonas aeruginosa
AQCSSVSREPNKESRMAGKKKSEKESSWIGEIEKYSRQIWLAGLGAYSKVSKDGSKLFETLVKDGEKAEKEAKSDVDAQVGAAKASARSAKSKVDEVRDRALGKWSELEEAFDKRLNSAISRLGVPSRNEVKELHSKVDTLTKQIEKLTGVSVKPAAKAAAKPAAKPAAKPAAKTAAAKPAAKPAAKAAAKPAAKPAAKKPAAKTAAAKPAAKPAAKPTAKAAAKPATKPAAKAAAKPAAKPAAAKPAAATAAKPAAKPAAKPAAKKPAAKKPAAKPAAAKPAAPAASSSAPAAPAATPAASAPAANAPATPSSQG

SEQ ID NO: 32958 - protein, 72 aa, Pseudomonas aeruginosa
DIRRGDRADRMSGLAVCGANVANDVPSFGAAEKNRLDAVCREGALGPALQSISLTTDSSGSRDLPALTSSAR

SEQ ID NO: 32959 - protein, 522 aa, Pseudomonas aeruginosa
RRVRVFEALCSWMAEGIRIASDSRKGGVQGYPGSGPRGPPPRCWPWRRRWSKDVAGQVLVLGQLAEVAVDVAGIDQDRLVAMLAGQVGGAERDLFQQPLEQRMQAAGTDVLGLLVDLPGDLGKALDAVLGELDGQPLGLQQLAVLLGERGMRLGEDALEIVRTEGLELHADRQAALQLGNQVARLAQVEGAGGDEQDVVGLDHAQLGVHRAALDQRQQVALYALAGDVGAAGVGALGDLVDLVDEDDAVLLDRLQGACLELFLVDQAHRLFVADQLQGLGDLQLAGLLLALAHAGEQVLQLVGHLLHAGRGHDLHAGRVVGHLDVDFLVVQLAFAQALAEQLAGVAVLACRLVAEAHGGTRGRQQGIEDALFGGVLGAILDLLDLLFAEHLHRGVGEIADDRLDVASDIADLGELGRLDLDERRVRQARQAAGDLGLADAGGADHEDVLWCYLGAQLGRQLHASPAVAQGDGDGALGVVLADDVAVEFVDDLAGRHGHSFTPAGDERFRRRCPAPRWSGSGW

SEQ ID NO: 32960 - protein, 1247 aa, Pseudomonas aeruginosa
VGAEQVRHALERDVVDQVAELRQLCGQGQLLGLLEDDLPAQLLAALAELAEDAGHAGAGVEQVGCGVAFEAQHQFEVEAVVAGAVLGQVGVLHRVDPHHPADLAQLDLVERLLATLGALLVAFLDQRIGAALGLFQQVDQLHRTAVAGLERTAVGAVHGAEAHVLQLHAGRNETGAPRHFEDLLEVQGLALVDEVQHAVGVQHVVPITHGGEVGGGVEVAAAGLLHDHRERIALGVLELFEEDAQRAVVFGEQALGGQVGDHLGEVVVVGALAHDVGHAQLHAETVVDLLAVRQGNLVEAGPQAQAVGVAGLQLDYQFAGAVGEFGRLVEAFLRRAVEDLQVVQLGLGVDRLLFQVGEQHAELGAPVADMVLPDHRVAEELEDARDGVADDGRAQVADVHFLGQVRRGQVDHHALRRACLAHAETFVGEGAVEAGGEPDVILEEVEEAGAGDLHLGQLLVGGDCLDQPGGQVARLHPGRLGQHHGDVAGEIAVATVLGVLHLDVRGQAGGQGAVRGQLVEGLLDQLANRVFHRFSPCSRAEGRRATVGQGKGRRMRRSEVHSPRCARGGRSRLRTAHYPWADRRCQPLRRLADSLRRTSRIPADPSQAGRLPGRRSEQVDRIDIERPAHLAPAGQLFEALQPGRQQAMQRRSAHALQQQLRAVLAGTPLHGRGHRPEQFHLRSAHLLEQLLGGTAGAVEEGFRLARLVRFGAQQGEVGEGRQAGGAAFAEGLFGKGEVAVLGELDQQRVIGQVGLDQYPPGLLGASCAAGDLDDLLGHAFAGAEVGGKQAAIGIEDRHQGDPWEVVPLGEHLGADQDAWLTAVDGGEEVAHGVLARGAVAVDAQHRMVREENPQAFLGALGAGAYRAQVELAALRAVHRRPLAVVAVVAAQLAAALVHGHPRVAARALADPAAVVAKQGRSEAAAVEEHQDLLAGRQGIADGLLQRTGKAGVERHALHVEADELRRVRATGALGQAQQAVAAGLGVVQAFQGGRGRTEQDRHILQARAYQCQVAGVVAQAVLLFIGGVVFLVDDDQSRSLQRREQCRAGADDDVGLAIPGGEPGVEALAVGQGRMQQGDARVEAAFETRQGLRPQVDLGNQHQGLAACGQGFADQLQVDLGLAAAGDPGQQEAMETAVAGANRLEGGALLGVQRQLRLGQPAAFARRGAVAPHLQLDQAFFLEQVEAVLVYLQLVQQLMGHPVRMLLENRQGLALARRPGQARIVEAGLRGGMPEALLARLGRLALA

SEQ ID NO: 32961 - protein, 327 aa, Pseudomonas aeruginosa
RHQDPFHPVQADPPGRVLRMPPVLHRQAEGAGHRRPYRPLQAAFRRIRRHQVSRLPRTRAMLLVAVPRKASLVGAFFMSVVSAFAGAAEACRPTGALQNVEVARVVDGDTVRLRDGRSVRLIGINAPELAHNGRTTEPFAEAAKQRLQALVSASDGRLALQPGRQARDHYGRTLAHLFDASGANLEARLLGEGLGYLVAVAPNTELTACQQAAERAARSANLGVWKRSPVLSLDRLAQSGFAVVRGRVLEVELNRGGIWLEMDGPLVLRIEPKVLKAFDAKRVMQMAGRSLEVRGWVVDRSRRGAVPAGKARWQMSVTDPAMLEWLP

SEQ ID NO: 32962 - protein, 476 aa, Pseudomonas aeruginosa
MTFIRAVNPVRAIGLKSYARGLDSRVLTILWGVVFLRMLGRPVCPTSNKAEVPKCPILKPLPSNITHNPVRGKLSVELTKPTATARDLSLAYSPGVAEPVREIARDAELAYQYTGKGNLVAVISDGTAILGLGNLGPLASKPVMEGKGVLFKRFAGIDVFDIEVDAESPQAFIDTVKRISITFGGINLEDIKAPECFEIERALIEQCDIPVFHDDQHGTAIVTAAGMLNALELAGKKLEEAKIVCLGAGAAAISCMKLLVSMGAKVENIYMIDRKGVIHAGRDDLNQYKSVFATETDKRTLADALEGADVFVGLSGANLLEPEDLKRMAPNPIVFACSNPDPEIKPELAHATRNDVIMATGRSDYPNQVNNVLGFPFIFRGALDVRATRINEEMKIAAALALRDLAKQPVPEDVCAAYGVDKLEFGREYIIPKPMDKRLITVVSDAVAKAAIETGVATLPYPKNYPLKSVDDVFNG

SEQ ID NO: 32963 - protein, 409 aa, Pseudomonas aeruginosa
GVSTDGTDQPSTLARRAARAAQAAVPGDSWRRPGGIGCAGIPWRPVLHRGHREPERPQRLPAQGNRRTRRPDQGNQRTEVAAPAIARADEDHPGPAGQPSHHRTGVRPARADLARRRVFHRPEDDRQEHRHRRRGRVQQPRFQSHAQHGRVRVADRPDPERGQGGDPGRGGPGQRVPTDRAADAARRGRRQGEAWGCARSQEMSLASSLESLRKIDINDLDLNNIGSWPAAVKVIVCVLLTAAVLALGYNFHLSDMQAQLEQQAAEEETLKQQFSTKAFQAANLEAYKAQMKEMEESFGALLRQLPSDTEVPGLLEDITRTGLGSGLEFEEIKLLPEVAQQFYIELPIQISVVGGYHDLATFVSGVSSLPRIVTLHDFEIKPVAPGSTSKLRMSILAKTYRYNDKGLKK

SEQ ID NO: 32964 - protein, 184 aa, Pseudomonas aeruginosa
SGHRNRSLISNNVVNLILVGPMGAGKSTIGRLLAKELHLAFKDSDKEIEQRCGANIPWIFDVEGEVGFREREQAMLTELCAADGMVIATGGGAVMRDGNRQVLRAGGRVVYLHASVEHQIARTARDRNRPLLQKPNPGQILRDLMALRDPLYREIADVVVETDERPPRLVVQEILERLRKLPPR

SEQ ID NO: 32965 - protein, 155 aa, Pseudomonas aeruginosa
GLPGPLPIQSRPVRAARSGFQVLPGAAQAGARPVAPSGPLQPAPAAGHRAPGQRQDPAAPGAGGQHQQGCGPQRGDLGAHRRRRDFVAAPGGAGPEHQPGEPGGDPDQGGAAGDHRAGRLPDGGRCRTAPGQRAGSAVAAGFRHQRGTPACIPVR

SEQ ID NO: 32966 - protein, 377 aa, Pseudomonas aeruginosa
GALPCHRIAAIQRRGNPRLPGPASRGRRAGHRADFQRPAGGHPRAVGRLAGSDQPGRPRCPDRSDAGQSWRSAQGNRRVFQLAQEASGDSCGRGHRRDRRLVHARQEQAGGAADRLYRIVHEWWYAGPGPAAGQRPGRGVQRLQPAVAATVGRRVAAGHSRAAGPGRRARWRRRRRPAVPPRCRLPFPARVLPGDAAGQQRRHADASGCPRPRPNRPPLRRPPIPGAGPRHRPGPVAKGPGQQAGPGPVSGPSRGRASRPPPPGGKPAPDPAAKPASGGGAGSQWYRNQSGGNFALQILGTGSEANAQAFIRQQGGGDFRYFKKTLQGKPFYVVTYGSFPNRAAALAAVKKLPSKVQAGKPWPRTFASIQQEIGQAH

SEQ ID NO: 32967 - protein, 273 aa, Pseudomonas aeruginosa
PRNTWSTPRSCRSRWPRAPMPRRGRPVAGRQGQRPDRPPALCGARRDPDLAAAAPRHLLHRRPGAADLRPQAGQPAGAGIGEAGIRAGRRHHRRRRGQGLCGPDHHLRLRRRYRRLADHLDQVRRLALGTGPGGNPPDPARQRPARQGPGADRWRPEDRPGRDQGGHSRRRELRLRHRADDRPGLQVPAHLPPEQLRHRRGDAERQVAQGPLHRHHRDGDQLLHLHRHGNPRVAGAPRRAQPGRADRPHRPAGDPPRRDRQAAESGSRSVAGQ

SEQ ID NO: 32968 - protein, 293 aa, Pseudomonas aeruginosa
SQQPLIGCRYDCPEERPLPPRPAQAARRCHPRLDDAPGRSLPAGIPCHPCQGRRFHEPVHEPGAGLRSDPAAAGPLPAAGRRDPLLRYPDHSRCHGPGPVLRDRRRPALPQGGLVAGRHRGAAGSRSGTGPGLCDGCRAHHPPRAERPRTADRLLRQPLDPRHLHGRGRLEQGLPQVQGDALRQPSGHARSAGQAGAIGDQLPQRADPRRRPGGADLRLMGRQPVGGGLPGVLPDLHAQDRRWIDPRARRTPGAGDPLHQGRRPVAGVDGRGRRRGAGPGLDLRHRQRPGPCR

SEQ ID NO: 32969 - protein, 645 aa, Pseudomonas aeruginosa
PIRSACGGGQGLVEVGEDVVDVLDADRQPHHVVGDSGAGQFLRVQLAVGGARRVAGQGLGVADVDQPHHQLQGVDEARAGGAAALDAEGQDRRRAAPQVAPGQGVLGVVGEAGVFHPGHLRMLLQVAGYGEGVVAVALHAQRQGLQALEDEEGVERRERRPHVAQRYHPAAADEGGGSEGLGVGDAVVGRIGRVQQREARLVRRPVEFAGVDHDPADAGAVAAHVLGQRVHDDVGTVLERPAEHRGGYRVVDDQRYAVAVSGVGQCLQVDDVARRVADGFAEHGLGPLVDQRFQGGDVVVGGEARLDADAWQGVGQQVVGAAVELGHRDDVVAGFGDGLDRVGDGRHPRGHRQRPDPAFQRRDALFQYIVGGVHDPCVDVARYLQVEQVGAMLGVVESVGGGLVDRHRHRAGGRVRAVAGVDGQGFQFHAAFLRADWKDAAWESAPGGSMRPGKEKRAWLDRCVRRLCLSAQADVDVVGADQGDQGADDDQQGARRKLLAQQGGERRGEQAAEDQSGDHLPGVRLAGEEDEGGGAGDGQEELGEVHRADGGARVATRADQAAGDHRAPAAAAGGIDEAAEECQLGHVARCPALDHVAVGLAQDVQAHQQQVGGDEGLELVAVEAGDQHGAEHRADHSRQQQAEEE

SEQ ID NO: 32970 - protein, 553 aa, Pseudomonas aeruginosa
RLVFGVDRTLAEIEVAYLHAARRLTGGGRTGWNKCGGEDNRLFLVRLRSFPKVFIPLRHYRPPFCQGIPSGGATDFQVPPPVRRAPSEALHARLFLERATQHLVQQADFRVVALLGRFDGLLCQVVAQHIERIDRVHAPAPRLLVSAFFLDAPAVGLGPAVEGLAVDEVVAQAGQRPLRSFFAESAEEQRVIHRAALHALQQFLDQGLVVLRGDAQAQAPAHQVEVVGLVEGQEQVEAGAQFVHFHQWRQRLGQGGQVPMGDRYLVAEGVAAGVVGVVADVIGVEIVEEGVGPVVEGNAEDRHVVGVHHPVAEAIGLPAGDEFGVALDDLAEHRRVWPLGCVAVGEVVFQNERRQLFQLVVLAGVVEVFEVTEAHVAGRQAQQRRRAFLLLAPDRRARTDHAERPAAGNAQCRKGFGGEELADRRAQHGAPVAHPRVGGLAGALEVQVPVLAGLVDHLAEQQAAAVAQARVIGAELVAGIHHRPRLGLRPQLVPAEQFGEQRFVAGFRWQVEQRQGGGAGYHQARLGDGVGQDFGGEGVAQAGEAVVEVEVVE

SEQ ID NO: 32971 - protein, 545 aa, Pseudomonas aeruginosa
GSAGRFGGTVLALERGRIADAAVLRLADEQLDLLALEVLDEHIDLVESHVDLVFAEAGGDLRQDLVGRGVAVAQFADVEAQLVVEGTGADGQEVQQRLRVAQYPRVFLDRLHHQLARQRQVGLVGQADLDGDPGHGIAQRPVHQLPGDEGLVRDDDLLAVEIGDGGGADADPADRAGQVADGHHVADSYRTLEEDDQAGDEVGEDRLQAETEAYRERRHQPLQLVPADPEGGQGADDADAADGVGKQGGGGVGAALGQGQALQYQDFQQAGQVARQGHGDHRDGQRREEVAQADRHAGGRFAGAGGVLVQGDVVEVGDHADQVGPDPVQADDEADQQGQSDQPQRLLVDLLDAEGRLLDVGLAVDAFLRRVLPFRQGPGVGQAPGRHAQAADEGGFDDEPEQQQVKGIDETVGELQRGVVVAEADRDEEHQRQRGEEDADDHLDQRRTFVAGAAEQQAAEQPGHGRVAEQDHGDADHVVGQTRRLVLGHRHHADQRQDHNAEADQVPVEEADLFAAPVEMPLGDAARGEDAMGGVEQQPDLGHFQ

SEQ ID NO: 32972 - protein, 586 aa, Pseudomonas aeruginosa
GAAEGGVLAAGVQQQGQPGDGKGQGAGQGEEDGDQDRQRGMQLAVALEVADVVVQLRQLVVQVAAFPQQRGDQQEQRQEQQRPIDQAFAQFTHPGAPGDLGELVLQQGRGHLEPGQVERLVAGNPEHLLVEGGAQALAGGKQLFLVQLQGDRFVEQRVEFVVEPFEQLGTGCQQGVEILAQFRRDLLAGLLGEQVVQVLLRGRQLVAFLVQFELAEAQVGDLVGQALVGLDLGQRLFLLVEDARQQQAAAQDVDLFLEGLVGLGQVVQLLLGLEVAPGEHVEAVGGTQEVVGETQVLGVLLAQQAVGAGSLGAFLGQLGDGLFRLLAALLADQRLQVEGFLFQARDLLGEQIVLALAEVLQQVVAGQLLAQQLALHGQCGLLGEQLAATVGVDRLAAFLAGLEQRADFQDPCLHAADAGLGSFRTGLGGDRQAVGLAQGFLPLGLLGGAVVEQHFQAGRALAAVAFADRTFFGLLQALQFALVFLDLPGRVAQALFQVLQALQRFVARGEELEGLFEAGLGDLLVGFGELALGQLVEALLDGLGRGRLGLGEERRTGKAEAEEKNSDQGAKGRHGREETRRRVNAG

SEQ ID NO: 32973 - protein, 668 aa, Pseudomonas aeruginosa
AYPGKNRWTVGGLRCRWKSPVFRRVGFAGRVGVERLSSCAPNSRLRVLWHSLAVRRDAVSPSRQAGKKSPTIRWGRETSVACSREGLAAPWGAAQVLQEQGADVRQQLAQALGEARRGGAVDHAMVVGQRQRQHQARLEGLAVPYRLHGRLGHTEDRHFRRVDDRREAGAADVAETGDGEAGALHGIGRELLVAGLVGQLGGLGGQLQEALPVDIADHRDQQAVRSVHGEADVYVLLADQRLAAGGQRTVEVRQFLEQVGAGLEQDRQYGQLDPGLLRRGLLGNAEGFHVGDVRLVELGHVRHVQPAAMQVGGADLHQAGHRHFFHFAELAEVDFRDRRDAGSAGGAGTAGLGALQLLLDEDLDVFLEDATLGTAGFHFAQLDAELARQHAHRRAGVDLGAVAAGCADRSRGIGLGWRRGRRGGLLLGGGRRGLGRSGCRLLFGCRSGAFHLQLEDQVAGADFVTDLDRDAFHHPGGRRGNLHAGLVGFQGDQRLVGLDRVAGLDHHFDDVGLAGRADVRDLDVLDAGRGGGGRLALARGGSRRFGFRRFRLGGRCLGLGFGRLFAAFHFQLEDFVTFFQGVADLRLDAFHYPGLGTGDFHAGLVGFQGQQALIGLDLVAGLDQQLDDFTLTVADVGYANEFAHIPLLLRATTAVRRAKQRLLVLGSL

SEQ ID NO: 32974 - protein, 921 aa, Pseudomonas aeruginosa
AGAARWRRRRARNPSLPRGVWSELAIQRVALLRIDPVLGDGLGHHFRLDIAAIGQRFERGQHHPVTIHFEEVAQLLAAVAAAEAVGAEHLVLLGGNPLADLLGVELHVVGGGDHRAATAAQALLDVALLRLLARMQAVPALDGKAVATQLVEARHAPDVGADAEVVAQQLGRFLDFAQDGAGAQQLHVVSGFLLVLLEEVHALDDAFLCALRHGRLDVVLVHHGDVVEDVLLLFDHLPRAFADDHRQFVGVGRIVGAAVRDGRGQQVAVAVLVLQAFAVQRGATGGAADQEAVRAAVAGGPGQVADALEAEHRIEDVERQHRLVVGAVGGTGGNPAGHGAGLVDAFLEDLALLVLAVEHHLVLVHRLVELADRGVDAELAEHAFHAEGTGLVRDDRDDARAEFLVLDQLRDDPHEGHGGGDLAIAGAVEHGLQGFQRRNRHAHALLPAHRHEAAQRGAALGQVLGLGAAFFRLVERQLLQVGVLDRDVELVAERAQAVDVDLLHVVRDVLRFAAAGAVALDGLGQDDGRLALVVDRLVVGRIDLVGVVAAAVELPDFLVGKVLDHFQQFRTRAEEVLAHVGAVFRLVVLVFAVDDLVHALLQQAGGVLGEQRVPEATPDDLVDVPLGAAEHAFQFLDDLGVAADRAVEALQVAVDDEDQVVEFLAAGQGDRAEGFRLVALAVAHEAPDLLLAGGDEAAAFQVLHEACLVDRLDRAKAHGYGGELPEVWHQPGVRIGGQAVAVHFLAEVLQLFLADAAFEEGPGVDAGGRVALEEHQVAAVFVGGSLEEIVEADVVEGRRGGEGGDVAAQVRVVLVRPHHHRQGVPAHQGADPAFHEQVAGHACFVGYRNGVAIGRGDRVGQLGAATAGQLAHAGHQVMSAVFTFAVEYGLQGVQPFLGFDGIEVLHGLLQGGKASRIGCHR

SEQ ID NO: 32975 - protein, 68 aa, Pseudomonas aeruginosa
FLDVLRGCTRRLVVLLQISLRNSPLDTIFSSKTTFRLSLSGYKARCRAFSTLCVEPVVFGRKPKQDRP

SEQ ID NO: 32976 - protein, 336 aa, Pseudomonas aeruginosa
SGSGASCGSADPLRHVTQVRNEYLKELATMSMADRDGVIWYDGELVQWRDATTHVLTHTLHYGMGVFEGVRAYDTPQGTAIFRLQAHTDRLFDSAHIMNMQIPYSRDEINEATRAAVRENNLESAYIRPMVFYGSEGMGLRASGLKVHVIIAAWSWGAYMGEEALQQGIKVRTSSFTRHHVNISMTRAKSNGAYINSMLALQEAISGGADEAMMLDPEGYVAEGSGENIFIIKDGVIYTPEVTACLNGITRNTILTLAAEHGFKLVEKRITRDEVYIADEAFFTGTAAEVTPIREVDGRKIGAGRRGPVTEKLQKAYFDLVSGKTEAHAEWRTLVK

SEQ ID NO: 32977 - protein, 401 aa, Pseudomonas aeruginosa
AAAVLHPAESPARGHPAGGHAAGPGDPPMTLAFILYKYFPFGGLQRDFMRIALECQRRGHDIRVYTLIWEGDVPDGFEVLVAPVRSIFNHRRNEKFTAWVRADLDRRPVQRVIGFNKMPGLDVYYAADACFEEKAQTLRNPLYRQWGRYRHFAGYERAVFDPASKTEILMISEVQQPLFVKHYGTQAERFHLLPPGISQDRRAPANAADVRAEFRREFGLEEDDLLLVQIGSGFKTKGLDRSLKALSALPKALRRRTRLIAIGQDDPKPFLLQIAALGLNDQVQILKGRSDIPRFLLGADLLIHPAYNENTGTVLLEALVSGLPVLVTDVCGYAHYIAEADAGRVLPSPFEQDSLNRLLAEMLEDAPARAAWSRNGLAYADHADLYSMPQRAADLILGEAS

SEQ ID NO: 32978 - protein, 339 aa, Pseudomonas aeruginosa
RPEVAQPAGGRPAAGVFHRLPERRVLVELHAALSDHQGPGLPGQGGQVPPVAHPAPALLPAISPSPAPERIRQEAYSPGGGFLRGARMSVFIAAQDHDLLQRNRLDSFDALWALQLDAVDEPNTERGGWSSVYRLDLGDSAYYLKRQSNHLTRSLRHPLGEPTFAREFRNIERYRALGIPALQAAFFAQQAVGGERQAILLTRALDGWQDLDTWLASWHDLAEERRRAILRAVGRLARQLHAAGQMHGCFYPKHVFLREGADGVFEACLIDLEKTRPIWFGRRDQVKDLEPMLRRAPDWSEADVHEFISAYVDEPLDSAEVEQWYRLLDQRRRRKESRR

SEQ ID NO: 32979 - protein, 589 aa, Pseudomonas aeruginosa
RGSTVALTVLGLSGAVSHDPSAALYIDGKLVAAVEEERFVRDKHAKNRMPYESAKFCLEQAGIEPADVDVVAIPFAPISIMEKARWHYAKRYAYAPDRALDAILLGNRRYKRYYKRIEWCLQQLGFDLKKIKIQPVEHHLAHASSAYHCSGFKEKTAILGIDGKGEYATTFFGWGENGRIHKIKEFYDPDSLGGLYGAITEYLGFDMLDGEFKVMGMAPYGDASKYDFSRLAKFENGELVINTDYANVIGFRRYKEKGKGYYFSPKLIEWLGPKREGDIADDPYIHYAASIQALFEKLALEMMDYYLGDIIRETGKVAFAGGCALNVKLNQKIISRPEVKELFVQPAASDAGTAVGAAAYVSHQRGVPVEKMEHVYLGPEYSNEDVIAACARHEARPQWQKIDNRSRRIGRILADGNPVAWFQGRMEFGPRALGGRSILGCPSVPGVADRINAQIKFRERWRPFCPSMLDTVGPQMFKIDHPAPFMTFTFEVNEEWKERVPEVVHEDGTSRAQVLKREYNPRYYDLMKELENLTGNGVALNTSLNRRGEPMICSPTDALNMFFGSDLQYLIMEDILVVKEGVDWYDSVG

SEQ ID NO: 32980 - protein, 284 aa, Pseudomonas aeruginosa
GGGALRLRRGTVPRVRLQGHPWPQAEGDPRLARDRPFARLPLLHRAPLQADLDRQPGHSSADRWRAPRLRRLPAVVAQGLRRPDEQAPEPAGGVRRGARRYPPLPAEVAGGADRDALQPHRRRCAAGRAGRAPECAPATAPARRGLGGRQRRPPASGQGPGYPAARLCRRAAAPAAEQPAGDPRQRPPGRAAQGPGLRTGYRRARAVPRPGRRGTALLQGVRRLRPEFRPRAVRHGPAGGHGCRCTADRHRLWRRPRSGGRGRHPLPAGRRDGPGRGPDPPGGA

SEQ ID NO: 32981 - protein, 340 aa, Pseudomonas aeruginosa
PPPARGLCAAHARAPGDTLLRRCGAPRILAPADDCRLRFGVCMLNRLRAFRERGWREVDAPTYAQAWQRFGGSVATHPLVVEQLAEMAGIPVRYLGWESAGELVAAIPTWGRHLALSKDVLKRRGKKGLYDLGNAELILPVAGDARIALRHAGRYLSALHERNIVTLRPQTEQLAFARAPEDFSKKFRYNQRREVRLVEEAGGQVRQADSFAPAEFAAIYLELFQRRWGFPATGAERMAEVFERLRELLRGSVLLLNDQPIAVQVLYRAEAPGWLSVEYINGGVDPQTREFSPGSVLSYLNTQAAWEDARALGKPLRYSFGRADREYKDRWCHPSPVFQV

SEQ ID NO: 32982 - protein, 473 aa, Pseudomonas aeruginosa
SMSARKQQLLKRHRRNKRIGLLVALLALLAVGLLVSPWLLPILLVALWVAHEAWFADHLFYSPGEDYRYRFAEGVESLPVRLADGRLRVDGELREGDTLVLGIGVRAGWLGRFLEPSVLLEGGAEADAQAFERGVNGLRYLNLTGLAGPLGEGRIRLRGRHCRLVGEPTLWRARHPDYRDRRVMVIAPHADDAELAAFGLYSQAREAWIVTLTAGEIETEHYRRMGLDGIAAARLKGRLRAWDSQAVPTWGGVPAERCVQLGYFCLQLPAMQANPGEVVPSREADLADIRPFRQFNRLRLASDADGLSTWNNLLSDLRELILLARPEVIVLPHPHFDPHPDHVRAQEAVREALQGLDWQPQALLHYANHLHDNDRWPMGDAHMGVSLPPLTEECSPLLPWTLALERTRQVDKAMALGMMHDLQPRPPFKRRLRRRLQGWLAGRRWPAYGEDEFMRKAVRRHELFWVESLDGEA

SEQ ID NO: 32983 - protein, 342 aa, Pseudomonas aeruginosa
CLGRAFGKVRAAMLLRSSREDEGLMKVLFLVQKEQRAILDRLYDGIAAHCECDTRWLSSEEQADLRGYFRKHVDVSRYDRILFFLRFKKEMRQVRFIRSVPNLVILEHDAYQNYIPCKYTGKFSAHYRRLPWARVISSGHTVSERLRQEGFDAVFVPKGYDQTLLHDLGLARDIELGFVGSTGSVAYSGRKALLDELGGVENLLVTKTKSGEEYLRTLNRIRFFVSADVGMGEYMIKNFEAMACGCVLLAYDQGERENEALGFRDMENIVLYRSVADIQEKLAILRLDTALAERIARSGQALAIERFSFAAVGQSIVEAMRPALREPERPGWLEKTWRRIFT

SEQ ID NO: 32984 - protein, 526 aa, Pseudomonas aeruginosa
WTRGRSSSAAATPSCWRRTAIMRGCTRWDWMSRRRRLSADKLGVCPERLFGVPMKLSMPRFDQAPVLVVGDVMLDRYWHGATSRISPEAPVPVVRVEQHEDRPGGAANVALNIAALGAQALLVGVTGRDEAADSLANSLKAAGVDARFQRIDSQPTIVKLRVMSRHQQLLRVDFEEPFRTDAAALAVDVESLLAKVKVLVLSDYGKGALQNHQVLIQAARARNIPVLADPKGKDFAIYRGASLITPNLSEFETIVGRCADEAELVAKGQALMSELDLGALLVTRGEHGMTLLRDGQPALHLPARAREVFDVTGAGDTVISTLAAALAAGEELPSAVGLANLAAGIVVGKLGTAAISAPELRRAVQREQGSERGVLGLEQLLLAIEDARAHGEKIVFTNGCFDILHAGHVTYLEQARAQGDRLIVGVNDDASVTRLKGVGRPINSVDRRMAVLAGLGAVDWVVSFAEDTPERLLEQVRPDVLVKGGDYGVEQVVGAQIVKAYGGEVRVLGLVENSSTTAIVEKIRQR

SEQ ID NO: 32985 - protein, 143 aa, Pseudomonas aeruginosa
SRYLSLLEIGYAVEPGADPPVRQRRRAPVVLCRRPRTEAGAIGGEQRHRAAGGGPRRHPVRTQQRTPAAPDRRGPGAAGGGARGAAPVRAPAGARAGAGARRGAAAAPGPGRGDALPAGAGQPGSAGAALSQSGGAGVQRRPG

SEQ ID NO: 32986 - protein, 575 aa, Pseudomonas aeruginosa
VAGAAAPRQRRDGHGVRCRPPAGRAATGQSPRAGTAPATFDRAPAERLSGRRADQPAGLAAGQLLFHGRAADAQPRLGLATAARGAVPHLRPADGGADQRLDAAGAGGRTGLAAQRGARPGGGLARRNLHPPPARHRLSRSAGVLLSCAPMNRTLYTLLFHLGLPLVALRLWWRARQAPAYAKRIGERFSLSLPEVPPGGIWVHAVSVGESIAAAPMVRALLERHPQLPVTVTCMTPTGSERIRALFGEQVRHCYLPYDLPWAAARFLDRVRPRLAVIMETELWPNHIHACAVRGIPVALANARLSERSARGYARFAGLTRPMLAELSWIAVQTEAEAERFRRLGARPECVSVTGSIKFDLRIDPQLPLAAAALREEWDATARPLWIAASTHAGEDEIVLAAHRRLLETRPDALLILVPRHPERFAGVHELCRREGFATVRRSGGEPVARATQVLLGDTMGELLFLYALADIAFVGGSLVPNGGHNLLEPAALGKPVFAGPHLFNFLDIAAQLRDAGALLEVTDAGELCDGLVRLWAQPEVATAMATAGEKVLRNNQGALERLLAGLARLLGRGG

SEQ ID NO: 32987 - protein, 235 aa, Pseudomonas aeruginosa
PAIIGAARRWSRATSRSRERMNQEVRFSRLEPEQRKALLIEATLACLKRHGFQGASVRKICAEAGVSVGLINHHYDGKDALVAEAYLAVTGRVMRLLRGAIDTAPGGARPRLSAFFEASFSAELLDPQLLDAWLAFWGAVGSIEAIGRVHDHSYGEYRALLVGVLRQLAEEGGWADFDAELAAISLSALLDGLWLESGLNPATFTPRQGVQICEAWVDGLEAGAHRRFRRAMEAC

SEQ ID NO: 32988 - protein, 278 aa, Pseudomonas aeruginosa
WIGCCWQRKAPRPLPPTVRQPRTRNAPARRRRKVMAMVPRVLVVDDDPVIRELLQAYLGEEGYDVLCAGNAEQAEACLAECAHLGQPVELVLLDIRLPGKDGLTLTRELRVRSEVGIILITGRNDEIDRIVGLECGADDYVIKPLNPRELVSRAKNLIRRVRHAQASAGPARQALRQFGDWLLDADRRRLIDHAGNETLLTHGEFQLLGAFLRNSGHTLSRDQLMDQIRNREWLPSDRSIDVLVGRLRRKLRDDPAEPQLIITIHGAGYLFTAAASDA

SEQ ID NO: 32989 - protein, 259 aa, Pseudomonas aeruginosa
AMQACWLALCGWLLGGLAQAAETIRYCDYPVYPPISWSDGQQVRGLAPELVKRLFGALGYRVEVVVLGNWRRCLLDAAAGRVDLILAYRTPARDRDLAFSAEPVLREDVAIFYNRQRPVRIQSLGDLAGYRGGLLFGESYGADFDRFVGRHGNVEWVSDSRQNFGKLVRQRIDYIAHERRTGTLFAERLAGGENIRALPEPLTVDYLRVAVSRHSPLAAKMDEIDRALRGYRDDGSIQRWLDDSVRDYRRLAGNRADAW

SEQ ID NO: 32990 - protein, 329 aa, Pseudomonas aeruginosa
WGACTPSTNPQSPPSTAAPWALAWTWRCAAISASPPPRRASRPATPAWPTARTPAPVGICHGCSAARRPSACCSSTKPGARSALWAPDWSARWSPTSAWLRRSAPSLRVSPAARPSPSPRPSACCATAPGARWPSSCVPSRPPGCSAGAARMPPRRCAPWPRNVPLNSAGARRRAGDSHGFQADPGTGHAGRGGAQLRREGTAAPRGRCRPRRRGVAGAGRTDSRQGPRRRFLCLQHARGSGWRRPRLPVPGAGRTRAVEGLLGPPRIRRAALEDPHGLHRRTARRLPVALRAGRKDRLLRPHRAGRRLRRQFDQDPRGARRRRLRDQR

SEQ ID NO: 32991 - protein, 458 aa, Pseudomonas aeruginosa
KPQAPAGTQASRLHWRPWHGACPETLCRRRFRRPVVAGQSAARRTRRRTLRGQRRRPAVRPGRGVRRHQPRTDPRRGRRARRQRRRRGDLLCLRLRRNRRTGPGRATPAAGRRRRNGAARPELLRLARLPARRRAMAGGTWRSAGGAGRRGADAEWQLRLQPVDERPFAAGGLYGIGGQPGAAGHRRADGRAARRAAGDCHRPASGRAEERPGVRPRSLQGVAERRAGDRPEDRGVGDRRGPRAQPHQFPGRFRRAIRQPVRAPRGDPRERPGELRRNPQGRRLRPPAWRAEPGRAGLFRRRRRVDRRLRRAQRPGVAVFRRRTARRTGRGAARLRQHRQPAGLHHRHLGRCRGPGGNARQRFAQPCRRRPAGARLSGRGNRRAAAVRPAFATLLRGAEVPRKSRLHRLGVPGIAAGPGPRAVARRGRRRAAGRRGWSRRLGTDRPLPPAPRGAAGAR

SEQ ID NO: 32992 - protein, 807 aa, Pseudomonas aeruginosa
GGVGADLPRAAGGRRLPARRVAIQAGAETLRPATAPGGAEHPRPGPRSGPRPRLPAGAQGGQRRTAAQDRGRWRGARPTQRGGVGGGIVRHARKPGPARAATGLRACFIGAHGWRAAGRADRRGQARGGLRPGIGDRCRRDTRGAAARQSQPAPANHRRGDPRCPAEPAQRAVAQRLPRSPGSVHGGPGGGDPRGRRIRLRTCRALAGAGRQSVAGGCRGSAGGGCVDPAGQWLKAGGTRRLPLPLVGMGARALRRERRLRWSPNWMRILPMQPQKTLTAGQALVRLLANYGVDTVFGIPGVHTLELYRGLPGSGIRHVLTRHEQGAGFMADGYARVSGKPGVCFVITGPGVTNVATAIGQAYADSVPLLVISSVNHSASLGKGWGCLHETQDQRAMTAPITAFSALALSPEQLPELIARAYAVFDSERPRPVHISIPLDVLAAPVAHDWSAAVARRPGRGVPCTEALRAAAERLAAARRPMLIAGGGALAAGDALAALSERLAAPLFTSVAGKGLQPPDAPLNAGASLCVAPGWEMIAEADLVLAVGTEMADTDFWRERLPLSGELIRVDIDPRKFNDFYPSAVALRGDARQTLEALLARLPQEARDAAPAAARVARLRADIRAAHAPLQALHQAILDRIAAALPADAFVSTDMTQLAYTGNYAFASRAPRSWLHPTGYGTLGYGLPAGIGAKLGAPQRPGLVLVGDGGFLYTAQELATASEELDSPLVVLLWNNDALGQIRDDMLGLDIEPVGVLPRNPDFALLGRAYGCAVRQPQDLNELERDLRAGFGQPGVTLIELRHACAR

SEQ ID NO: 32993 - protein, 204 aa, Pseudomonas aeruginosa
PPDKESIHALFRLHSTYRRRRRRCLGHPLSRAGAGRAGRGNPPAVGRRPRLRYPGAHRPGGHRQPAGRQHPLRRRARQARPAPAHRRAPPAAQRPGGGRGAGGGAGRCPMRAVRGGAVPAESGRRGDSRRADVRHLRSGVRRLWRAGGAGAGALREWLPRAGRGGRRTDHPAHARDGAEQPAQPVRRQPAAGHLGSPGRAVHGP

SEQ ID NO: 32994 - protein, 479 aa, Pseudomonas aeruginosa
PVDDLRRGLQRTAVRRRACQPGQPAGDGRPYRDPQQPVEIPRHDRLAGRLGGRSRSTLRAPGEPRPVHALWLAGIHPGCRLHRAGSAAAGVGGDARGLPPPPRPGNRVPGRQPRPASTAPGRRHVRDGRHPSHRTFRPGLRRPPAGPPWRIGARRRSLRPERRRSHPPRPGVGRRTAARSLSAHCAVRRRVARPGLNPSAASDAAGHHDSETTMNVLIVHAHNEPQSFTRALCDQACETLAGQGPRGAGLGSLRDELESGGQCRRLRRARRSRLPGVRPGAARERQAPEPGRRHPGRAGQAAVGRPADPQLSDLLVLGAGDPQGVVRPDTGVRGLLWRQALLRPGWPGRQEGAGQPDPGRAPAHVRRGCHPRTAGGHAAADPARHPGLCRHAGAGALRRLARAIHQRGSARQLPARLPGAAGKSRAGCTPAVPAAGAVRRAAPAAGALTRATRARPVKPRRPRPGASWLVLVLLARLAL

SEQ ID NO: 32995 - protein, 528 aa, Pseudomonas aeruginosa
LLGGGLGQVRREEVLVRIVVLLQVGAERLQVGRAEGAGRLLQAQGIEDVVVAAVVVVAHGGVQLALGVEHVDDVAGADLVADLGGFQRTLVGDDRLAPRLDLLDVGIHRAVQVAGILHHLAALAFAGLLALVEALVGLADLGGGQAAAVDRDVQFQANAALVDILAIVHQRIGGAVGEAEGVVVALLVLGHGIEGRQVPGLALAEGFLGGVDRVVAGQQAQVLLHRGVDPGLGVVRRRRHHRQGVAHALDGAVVAVGQGHQGLEGIVHALFGDQPVGAGGVVAGLGLEHVGLVGKAHVEALVGLVQLALEGGFLGLAGGQVVLGAEHREVGLGAAQDQVLLGRGEFQPGLVAGFLGGLPLEPAVGAEQRLAEGGLDDLAVALDGRRTLVECDPGVSDAGAGAELRQQAGAGLGHHFLARQVVGLGGGEVGVVVDGFLVDADQVGLGRQRGRLGGPGDTGSSGHGGRQGESAQHSFVLEKMRGGARLRSLPVAVKAPARQLIEEPVRIDVPANVRGSASSLARGRRTGP

SEQ ID NO: 32996 - protein, 634 aa, Pseudomonas aeruginosa
LNRDPMATYNADAIEVLSGLDPVRKRPGMYTDTTRPNHLAQEVIDNSVDEALAGHAKSVQVILHQDNSLEVIDDGRGMPVDIHPEEGVPGVELILTKLHAGGKFSNKNYQFSGGLHGVGISVVNALSTRVEVRVKRDANEYRMTFADGFKDSDLEVIGTVGKRNTGTSVHFWPDPKYFDSAKFSVSRLKHVLKAKAVLCPGLSVVFEDKNTGERVEWHFEDGLRSYLTDAVAELPRLPDEPFCGNLEGSKEAVSWALLWLPEGGESVQESYVNLIPTAQGGTHVNGLRQGLLDAMREFCEFRNLLPRGVKLAPEDVWERIAFVLSMKMQEPQFSGQTKERLSSREAAAFVSGVVKDAFSLWLNEHAEIGLQLAELAISNAGRRLKAGKKVERKKITQGPALPGKLADCAGQEPMRAELFLVEGDSAGGSAKQARDKEFQAIMPLRGKILNTWEVDGGEVLASQEVHDIAVAIGVDPGASDLAQLRYGKICILADADSDGLHIATLLCALFVRHFRPLVEAGHVYVAMPPLYRIDLGKDIYYALDEAERDGILERLAAEKKRGKPQVTRFKGLGEMNPLQLRETTMDPNTRRLVQLTLEDATGTLEIMDMLLAKKRAGDRKSWLESKGNLAEVLV

SEQ ID NO: 32997 - protein, 312 aa, Pseudomonas aeruginosa
ISTRCSKGSPSTPRASASGWLPSASAAACWWPTATTVPGAARAAAYCSPRAARSSRRRNWAARASCRRISPTSPSTAASCSPWSAWRIRSVAATWPRPRSSAAGRSPRRSWRRSVATSCLMASRKPCRWTTRAPGWASTMATMRAPMATCGPSSCASPRPPAAGWGTSDATGARSAAGTDHAGAGLDRRAGAGDALFRRLGRSTAQPEPGAAIDPWRRLRRVAPGQQPAGPLPAERADQRPGRDLPARYRGDPGGGAGSPGGKTRAGARRADHPEHGQRPRHGLAHAAGPAATRRYPPVRGRGADCAGHGRR

SEQ ID NO: 32998 - protein, 222 aa, Pseudomonas aeruginosa
WRSRSPIAIRWWTARATGGRRTIPSPSPPCVIPRRACRAIPRCCSANWARVPWTGYLTSTAPWTSRPCCRPACPTCCSTAPPASRWAWPPTCRRTTCGKSRRPACACSTSRARRSPNCANTCRARTSPPKPRSSPRAPTCRRSTRPAAVRCACARCTASRTATSSSTPCRTRCPVPRCWNRSPGRCRPRSCRWWPTCATSRTTRTRPASSSSRVRTGSMSKS

SEQ ID NO: 32999 - protein, 248 aa, Pseudomonas aeruginosa
PWCSRTKAGCVAPRATTSTPPAFPTKPATAFMPPRRDARTSMRCASTPPGRSYSLPAPLPAVRAGPGRAAQAARLTPPPGASFECVLLPDDDALFVIASDAGYGFVVKGEDLQAKNKAGKALLSLPNGSAVVAPRPVRDVEQDWLAAVTTEGRLLLFKVSDLPQLGKGKGNKIIGIPGERVASREEYLTDLAVLPAGATLVLQAGKRTLSLKGDDLEHYKGERGRRGNKLPRGFQRVDSLLVDIPPQD

SEQ ID NO: 33000 - protein, 326 aa, Pseudomonas aeruginosa
YAPSAAVSDGGWPVEFKSCISSADLRRNTVVLDERVARLRMSFPRQPARADGLCGPSAGPALPVGRRCRCGTEKGRRCGRPARAGTTGRLSQARCDGAAAGRWYSQSVHRSALGRQPGDQCQPATAAADVQRAGQQPPGAVPGKTRFHPPGPGDADHQSPRLRPQAAGSDRGALAPVGPEGRPEGQPGVPRGRTASGQHRRPDPCPERPAQAPGGAVGQGRQADRRGGRGAAAGDRAQAGGQAEGQGRGRSENATGGADSHRRRGLSVLIVDSRPGESPAEAGLFRFGVSVSGATGSAGPCRRAPAAGRAARPSAPPIAAPAIRVR

SEQ ID NO: 33001 - protein, 523 aa, Pseudomonas aeruginosa
SGWSRAGAVVHARQLALEHRRIRLQQTLDAAGSFRTGDGADTGALADHRVVGDAAFDQQQVAAVLVEGEGVLHGFVEQQVGLGLFAEVFAEAQAQLQLQGDAAVGDLDLQGMAERTHQFTAAERVGQVVGAVVAAVEENQAAAVAERVQAALVLAGGLFQAVAIALQEIHQAAARQPAQLFLGAELDRQHRTVLRFARSGGRCGLFPGFGSVLVEGVLVQRVFVDGGEFHRLGLVQQGVAQRNVVFLEGRGLDLAAAQVGFVVFQQDVVEVLRQRCFFRLRRRRLFRHQALFQVARQVAQLVLQFGAGGRIVRITQPDTQLQQGCGNLPPQAQAEIQGEDQQDQADQAHALQADHHRLLKLLHVQADAQVPGDHFLEGDRRRVQAFGGAEQALLRTAAGLGEDALVDAVDRRMGHQRVLHQVVQQHVEAEDVVGHQQLGGGRGGLGDQALAQGIGLLLHGLAKLHAHDPGVDQQGQGHQDQAMAGEPQGDRDAALAQGTKQQEEEIVGLDGRGPGHRGLGLLK

SEQ ID NO: 33002 - protein, 190 aa, Pseudomonas aeruginosa
TGLPRQLQGAPGAAAGAVGRRAGGDRRLAASDRGCGNPVRRTQAPGLQDRHPVRRLHLFRPSIAGEAGDRLRVRQRVADRRRQGHRGGGRADRRCPAQGRPAARTGGEGRPEPGADHRRRRRRQRPADARPGRPGRGVPRQAAGQAVGQAGDLDPGPGRHPLPARLPRPRRTSLRPAGVSCRPGSHEPGR

SEQ ID NO: 33003 - protein, 747 aa, Pseudomonas aeruginosa
SGKATGAQGARSSFVSRGEVVVHRLARPLQVVALDVGGAGLPQGGEDAGALDEGDDAELLLFVQFGDQALEDLLVFHLVEVLDEGTIDLDELHGQVLQRVERVQRAAELADRRLAMQGGQALGQLLGLLQIAGGVSFADLEHQRLRRQARGLQRHPEPGQQAGVLQARAGQVDEQLGLVPLGAMLGEQLNRIEDHPAVDLLRQPGFLGGMQELRRRHFLALRIEQAQEHLVVLVAVAAQADDWLEQQAEAVGLQRLLEDRDDVAALGGGGKLFRRVVLLDLRPALACRVIGAAMRTVHHVLGLGGLLVETGDADAEGGLGAAAVQLEKVVLDFLQQSLQRRLRLLGSLALEQGGEDRIAETRQVGFLAELFTHQSGQLAEQQVDPGKPVVGLERGVAVEMDIGQGRRLAGGHRLLHGGIHQVEEVAAVVETGDRVLAADFAELFFQLGVVDLAADHHLDAGFAVVRGGGEADARLEFLAVELDPGANQFGLALVVLVALEEILEGALVAGGDQVDDRQAFQFLGVLVAEQRHVGAVGVDVHAVVDVGDGVDRAVEQQLAAFFRLAQGEFGGAARAAFGEAGQLAVGDQHQALVLALRQGVLGAEHQGVGDGVGAVVGHQLDERDVARLAAQGGERLAGLETLAGRRGDQQVPALLEGFGEVLGRGQSMYAGRVAGIAEQTDQAFGFVLRVFQNQQADGFLFDGHGKGSVRVRAGAKRRRMEGSGQSTETSRASQNLPPPQAAGPLAL

SEQ ID NO: 33004 - protein, 158 aa, Pseudomonas aeruginosa
TVSRAASRSVSTAAGSRVRAPRRAVQCCSGASGCSARSRAAAESGRPARRSGRGCAWPVRRAPRDDARRAGWPTGRAGGVPAKAPRGPGSTTGWRGSAARTGCGSPAGCRPRAAARGRGCCAALPGPRSACSRWPGGSAGPGRGWRSCAAVRRGRWPG

SEQ ID NO: 33005 - protein, 432 aa, Pseudomonas aeruginosa
SGPPSRRLRRRRPRRSPPGGGPARRTGLPGRPSPVAGRVPGVVPTGCVWGRRNARRGYALRRSGRHWSGRPGSARARPGAARGRWARSPMAGRRRRTCEYPRVEEGQQFNGKRARPVCRACPSFRAALAAELLDRALGALGGLGEGLGMQVAERLAAEVGQDQHHHPRAVAQRAQQQVRSGEQLAQGFAEGRQQLVLVVRADAQQGRLLEQFLQQRAAGNLQLQFLLARFESGALLRQHVYLCAIGHQQQHPLQAAGAQRIAGTGGELHHVAERAGLAEQLGAMLPPLGQGFRRGRRRGRRFGTPAAGLPGPDQGHRRMPQRRPGVQARALRGEHVHLLLDFGQRLAQVQTGQALPAQHVRPVPALVRGDGQAIGEESAVGRLGQPAGEIGLGIELLLLEQGRLMVAGDTQGSNQQATVAGEQAIALDDPLR

SEQ ID NO: 33006 - protein, 347 aa, Pseudomonas aeruginosa
MDNNQPIIVKRVKRYAAGHHGGSWKIAFADFATAMMAFFLVLWLLSSATPEQKKAISGYFQDPIGFSESASPYVIDLGGTPTPAPDKTLNPQVQAQPDSNESRISPEQDHQVNADQAENLAEQVERERLALLLQELQNKVDENPMLKDFKDQIHFEITRDGLRIQIVDAANRPMFDLGSARLQPYFEDILLAMAETIRQVPNKISISGHTDAKPYAGNGDFGNWELSANRANAARRALVAGGYPEGQIAQVVGYASARLFDDKDPLNPVNRRIDIVVLTRKAQKAIEGETGAPEASAPAAAPGEQPKPAAEAPAAGAQPSLPADEVQKKLNLFDDGGSLKLEQIKGD

SEQ ID NO: 33007 - protein, 345 aa, Pseudomonas aeruginosa
GSVVRFRHACQNVPVAGHALRHDAPVLQGLEQGATWFTVVLAVAEAAMSEQVAELDETGLDIVSRHVPQAELTDAGRVDQVAAAGKMEQSRGGGGMGALAGHRGEVADTCVDTWQQGIHQRRLAHPGLPDEDAHVTVQRAAQFVHRQAIEGRHLDQRVTQGAVDIQQRIDAFGIALVDQIGLVQQQQRLDAGMFGGDQVTVDQVGVRFGTRGEDDDDAVDVGRHRLEQPAHVRAAQLGAARQLRDDHADALVAGAPDHLVASHQCRQVGAQVTAGNLAVGGLDLYLNPEMSDHLAGLLRSQVAALQLFHGTRLATGRPGRAFFLDLFDAPALPAGQVAFGHDASA

SEQ ID NO: 33008 - protein, 186 aa, Pseudomonas aeruginosa
RLERLPMQNPQNLIWIDLEMTGLDPDRDVIIEMATIVTDSDLNTLAEGPVIAIHQPEEILAGMDEWNTRQHGQSGLTQRVRESTVSMAEAEAQTLAFLEQWVPKRSSPICGNSICQDRRFLYRHMPRLEGYFHYRNLDVSTLKELAARWAPQVRESFKKGNTHLALDDIRESIAELRHYRDHFIKL

SEQ ID NO: 33009 - protein, 510 aa, Pseudomonas aeruginosa
RRIDPMTMTFQHDDLPLALYSAAQVRDLDARLIAAGTPGFELMQRAAHAAWRALRRRWPEAAALTVLAGDGNNAGDGYLIAALAQRAGWRVRVLAVAAPQRLAGDAAQAHAAALATGVVVEPWSECAVLEGVVVDALLGTGLAGAVREPFAQAIRLANAADLPVLAVDIPSGLSADTGAVLGEAIRADLTVTFIGLKIGLFTGDAPARVGELVFDELGSDAVVLQALQPRARRLARNAPAEAGSAAADRTQGAVRPPAGGRRRHRHGRGRATGRRKAPLRCGARAGLGGDPRSNMCRALLSRCPEVMAHGVASANQLLGPCRTRQRAVARSRSWPARPGGVALLSAVRSRPLPQVWDADALNLLALEPVGAGPRTWILTPHPGEAARLLGRSTAEVQADRPAAALELACRYQAVVVLKGAGSLVAAPDGRLAVCSQGHPAMAGAGLGDVLSGITGALLAQHVEAFEAACLAVWLHAAAGERLGAQGRGLAATDLIPTVRQLLEECSPCLK

SEQ ID NO: 33010 - protein, 124 aa, Pseudomonas aeruginosa
FCWPARSARFWPPRKSRACGSGALRTTPVWSSISPVRCSTACSPWPRPTVSSSTSAAPSWRPSSTVSSSATPRSPRCAPPSARPTTCAWSSTCRRRSPRKASSCRPTSNTATAWWSISTTRAPT

SEQ ID NO: 33011 - protein, 493 aa, Pseudomonas aeruginosa
LPLWHPASCAGRGPSRRPARAARGDQPDRAASDRRCRRRVRPAGRDAPGRERAGESGGTGGLEWRLIGLRRLLRLFRLYPAGGAALSGRGRWRLQGLLRAVTRGRGASRVARERPGHPAAGLRPGAAQGHLHFRRERPRPGAGGHARGPRADHLRAPQGGDGQRRLAWAAVAGAGVDRGQRARGGLRGRAFQLVPAPGLRAAAPGAGKPGDPADPCAAQAGGGDPVGARCHRRPAGIRHQRPYPGAPERVARHHGLPWRGARQPAPDPAGNERPVARHGNHRAQRPVQPWASDLDPTGPGRAGQALPARTLSLAASGAKPEAMRFVQERSDVFPASRHLSHGADRRRQDRPGDGAGRCAALRADQRRLGADLPRHGYRYGQAFPGAAGALSAPPDRYPRSGGELFGRGIPRRRPGGDGRGHRARQDSPAGGGHHALLQGVGSRAWPTCPAPIPRCARRSRPRPCPKVGTRCTGNSPRSTRSRLRASTPTTRSD

SEQ ID NO: 33012 - protein, 150 aa, Pseudomonas aeruginosa
ARGWYAAGPTSNGRKAVSVCAVRARPSWKPTDACCACASARSSSAWRRSAASASRLDAGASARISRRSPWSAIPTPANRPCSIRSPPPRCMPPTSCSPPSTPPCVACNWTISGRWCWPTRWASSATCRTSWWRPSALRWKSRATPTSCCT

SEQ ID NO: 33013 - protein, 404 aa, Pseudomonas aeruginosa
MESAMAWNEPGDNSNNNDRDPWGGRRGGGGGGGDRKGPPDLDEAFRKLQDSLNGLFGGKKRSGNGSGSGSGGKGGGLGLFGIGLAILAVLWLYNAIYVVDEQEQAVILRFGKYYETVGPGLNFYFPPIDKRFQENVTRERAYSKQGQMLTEDENIVEVPLTVQYKISNLQDFVLNVDQPEVSLQQATESALRHVAGSTTMDRILTEGREQMATEVRERLQRFLDTYRTGITVTQVNIQSAQAPREVQEAFDDVIRAREDEQREKNQAEAYANGVVPEARGQAQRIIEEANGYRDEVISRAQGEADRFSKLLVEYRKAPEVTRERLYLDTMQEVFSQTSKVLVTGQQGQNNLLYLPLDKMIDGRNAAPATGAGASAGGGSASASDLGSRIVNDLRQQDARTRESR

SEQ ID NO: 33014 - protein, 404 aa, Pseudomonas aeruginosa
RPAAGETQQPAPVPRRAGVEPRPRQGRADPGRLPGVAGEDPRPRRLPPDPDGHAAFAQPGGVQPGQQWPLRPQLRRLHPLHLADPALPGPAGASCDPQCDPLQGGDSARAAGRRGEHAQGAYLSVRRIAPGPVGRAVLDDRAACRRGHPRRDQLAEVRIHARAGRRDLPWRNHCGHRFRSVRRADRHLRRRPGPCDRAARRLLSFRRRAPSPQRRTHRAQLPSRRHHGSGSGAGRPGRAEDRFRAGRKRAERADRTQEAQRRQVGERRQGAEGAQGRIRARGRPGAGAGQSRRRGGAAAQGRQGAGAAAGRAGAAGAGRGDARQHRRAQESRGEAGAARRGACRRQGQGREEGQGRSCGQEREGQGQGRQARRCRQAGQADQASQGAFQAEGRQRSGRHRGAQT

SEQ ID NO: 33015 - protein, 251 aa, Pseudomonas aeruginosa
GQVMSQWEKVYGVHAVEALLRHHPKRVKQLWLAEGRHDPRVQVLTELAAGFRIPVGQRDRRELDEWAEGVHQGVVAEVSPSQVWGENMLEELLERSEGVPLLLALDGVTDPHNLGACLRTADAAGVQAVIVPKDKSATLNATVRKVACGAAEVIPLVAVTNLARTLEKLQQRGLWVVGTAGEADKTLYQLDLKGPTVLVMGAEGKGMRRLTREHCDFLARLPMAGSVSSLNVSVATGVCLFEILRQRTPLE

SEQ ID NO: 33016 - protein, 80 aa, Pseudomonas aeruginosa
GANHMARFFRRRKFCRFTAEGVKEIDYKDLNTLKAYVSETGKIVPSRITGTKAKYQRQLATAIKRARYLALLPYTDSHGR

SEQ ID NO: 33017 - protein, 293 aa, Pseudomonas aeruginosa
GIDRMRALAEFTMRGRMQATLAVAGSAVVPLLFWLSAAAGSLVLLRRGFGDAFGVLAWAVLPAMFWWYLGDPSILLVLLGTLTLAQILRASTSWSHVLLGSVAVGVVFALVLGHTSSELIGALATEVTKVLTQLRGESQLSGEELDKLQVALVPTLTGVMASSLQVTCLLCLMLARYWQASLYNPGGFGREFRSLRLAPAVAVILLLGAVVVPALEVQAAVLGPLCSVPLIIAGVALGHGLIALKRLAGGWLVGLYLAVLLLGNLICLLAVVDSLFDFRGRLARRQGSTNGEG

SEQ ID NO: 33018 - protein, 155 aa, Pseudomonas aeruginosa
KLRGKTQMEVILLEKVANLGNLGDKVNIKGGYARNFLLPQGKATVATAENVAAFEARRAELEKAAAEKKAAAEARAAQLSELVVTLGAHAGDEGKLFGSIGTRDIAEAVSAAGYPLEKAEVRLPNGALRNTGEFDVAVHLHTDVETTLKLIIVAE

SEQ ID NO: 33019 - protein, 149 aa, Pseudomonas aeruginosa
PSPEQLEKEGQLAQVGGPGLSRRTGEEHSLGRQHQGLRADHPRARHPAPTDRHQQRDRRQRLPPGRARRQRDPRRGRAEDLRDRRSATEDWRAGRDQRYPGQDHRPHRLPVQHHRGADRGVHRFHRPRREDQRPAAGRPDHRRRASVDG

SEQ ID NO: 33020 - protein, 368 aa, Pseudomonas aeruginosa
APVSVAGPDAMRPLVATVDLSAIRHNYALAKRCAPQRQAFAVVKANAYGHGAREVVTALHDDADGFAVACLEEAAEVRALHASARILLLEGCFEASEYALAGQLRLDLVIQGAEQGEAFLAAGLDIPLNVWLKLDSGMHRLGFDPAALRAWHARLRNHPGVRELNLISHFACADERNHPLTEQQLESFLGLLDLDFDQRSLANSAAVLTIPAAHMDWLRPGIMLYGSTPLADLSAAELGLRPAMSLGAQLISLREVAVGESVGYGATWIAERPARIGTVSCGYADGYPRTAPAGTPVLVGGRRATLAGRVSMDMLAVDLSDLPEARVGDPVELWGAGLSVDEVARACGTLGYELLSKVTARVPRRYSH

SEQ ID NO: 33021 - protein, 142 aa, Pseudomonas aeruginosa
SDPGRSAAAPCCYRGGARRPGRFRRTPSGACGCQARSAGRDGRRTAVALRASATGDWPRSTRWYGLPRRVPGRAGRCAAGPGARSFPGRPGPGPGPFPASDPGCARRAPGRTAGPPGSAPAGRPWRWPRSAGPARWRASRQG

SEQ ID NO: 33022 - protein, 321 aa, Pseudomonas aeruginosa
GTDHPEPLARLDHPRDRGDARQGARLHRRGLRPWRTDGEHVPHRLQEPGHRAALPQAILRVPRHLREPRYRPQLADRAVPQGPGAAGGEEDPDRLRPALRPRRRVARVRQGTGDPPRRRLPEDRPGAHRARSAGQDDEAGDRHLRPLQADVREVLEGSRQGAVPDPVLHRRPSRDHRRRHDEPGPVAQAQRLPRRPGPGVLSFADGHCHRYVSLGQEPAAQGHLQERWRDHRQERPAAAPAQGLPALPRPERLAAAARGAGADGARRPDRQWQAPPGPDLPAGYRRIPERSAEELDAGRQQEGRQAADPAYRPAATRQRRW

SEQ ID NO: 33023 - protein, 242 aa, Pseudomonas aeruginosa
AIAPAPGPGGTADPGERRHLQRLRRSQGHRPPLGAGPSAEPAVRRRVAADRRWCGAACSAAQCAAGRPVRRPASARRRAAAQRTGLRPSELPLAGARHPAARRDFPAQLCRGPGARCRRTLAGPCRPHPGSVRRGLCAGEPADRLAGLAGTLSRPARAASRRVFPHPAGDPRQPGRRRRRDAAGGAADSRTFQRNLLRASLPGAPARFPAGRGARPDGARRHPLSQDPRRPETGARGIAASR

SEQ ID NO: 33024 - protein, 405 aa, Pseudomonas aeruginosa
RLLRPAGIAYRLGAGHSRPARGGTPGARTGGQRVGQRGAGIARPARLPAAGLSPPARRGVGAALARHPLVRRAAGTRGDTRGTARPGDQAGLSRPALRTSVRPRPRRCRPGVPRRALARAPAGLRGATPGAVVPGAGLARRRGRRRPAVAGHRHARVRRRRRRRPLLGDARRSDPRSLGGGCRGGVDATRRREQGHLGTGRACGRRRAVAAAPARRARPGPRGSLPAVAGGGKPVLVRPLCRALRRPRAPAAGGAVALRGCRWRRRGAAQRPGPGRRHRPAARGWRAVGKVPVAGVARRALAGEPVRQPAAPALGGGAGARALVRGELAGLAGAATRHAGARSGTHRPRRSAGLPQPASDVPGSLVRFRPRRHDPRRRLAFPDDRPAHRARALLRREHRRLPRRR

SEQ ID NO: 33025 - protein, 416 aa, Pseudomonas aeruginosa
QRHHLPLALPGVAATGPGARPAPVARAEPALAALPVAGPGAFAGAPARGVRRATRAGTQDPGRTPAQLRSGGPGKPAVRRGRTRRGARRAGATAARHRRLRRTGLRSARLALFRPCRRCQPENGIHLMSAPALRSVPLQGARYQVLHDTHYRYATPVSLSRQLAHLWPRECAWQACHERAIADRAGGRARPRGCPRRIRQSAEPGGLRASPRGAAGQRATAGRSVRPCAGATDRVAGMGNRRRRAGIFRAGAVRRRAGSLPLSRRVALCAHPAAIRRVRRRLLPARTAVAGGGGGTDGEDLPRVRLRCAGHPGGDAAGRSAGAPSRGLPGLRPPDARLPARARTGGALRQRLPVDPPAARAGATDRRRRLACLGLAVLPGERLGGFRPDQRPVARPGAHHPGLGAGFFAMCRRCAG

SEQ ID NO: 33026 - protein, 321 aa, Pseudomonas aeruginosa
LFQNPLRTLSGQGPEPAFPVPGAVLVRSQTPSLRTVSDMDDTTIVNVGTEKINALWAMVSQYAFAFGIKILAAIAFWVIGRWLIGFAVGMVQKSLERQKVDPTVLRYVGSFITVTLNVLLVVGILGFFGIQTTSLAALIAAVGLAIGMAWSGLLANLAAGGFIIVLRPFKVGDFICAGGVTGTVKEIGLFTTAINTPDNVLTMVGNNKIFGDNIQNFTHNPFRRVELKAQLSGAADYQAAIALLKQRVAAIPNVLGEPPVDVEILEFNLVGPVLAVRPYCHNDHYWQVYFDTNKVIKDALGADFPAPMPAQTVIVQQSAGA

SEQ ID NO: 33027 - protein, 250 aa, Pseudomonas aeruginosa
CGPATVAAAGRVSSGKGFRVFFRLLLIAVLLAVSACSSKAPGPGASVPKVVRGEYRVKRGDTLYSIATRHGWNYKDLARANGIRPPYAVKVGQVVRFDGRKSTYVASSRSSSSSRARKPPPPPPSVTLRGWQWPMKGPVIRRFSSSDKLNKGIRIAGTLGQPVQASLAGKVVFAVNNMRGYGNLVIIQHGTSYTSTYAHNSRLLVKEGQMVSKGQKIAEAGSSDADRVQLYFEIRQNGRPLDPLSLLPPS

SEQ ID NO: 33028 - protein, 125 aa, Pseudomonas aeruginosa
RAGGTGGLVPAGSEGRTALLWRRTPGGLKRGVTMSSAEVLASVDIVALRLNPGHGLELLLIRRAQAPFAGQWALPGVLVNGRSADHSLYDTAVRPPALPGAGWSRLTSSRCPRSATRYATRAAGR

SEQ ID NO: 33029 - protein, 83 aa, Pseudomonas aeruginosa
LLHHADRAAGACLQGFDHLADGFGGLVRIGGQAAHFIGDHREPASGLARPCGFYRGIEGEQVGLLGDVLDDFQNGADFLGLVA

SEQ ID NO: 33030 - protein, 105 aa, Pseudomonas aeruginosa
ESRKRVDSSTCCRMRRTSARYSSPAGVSCKRLRTRRNRACCSCSSSCATCLLMALWVRLNSSAARVKLRCRATASKHCRAVIDGRRRLFSMAGFLARVERAERVI

SEQ ID NO: 33031 - protein, 428 aa, Pseudomonas aeruginosa
FPITKIKTERRAKVLVAGHSGKKRMARRLLCLLSETQQQHRSYERQHHPQEQHPMSKKLFRKGILALAVSSVMGLSTHALADVVIGVAGPHTGANASFGEQYWRGASQAAEDINAAGGINGEKIKLVKADDACEPKQAVAVANRLVDQDKAIAVVGHFCSSSTIPASEVYDEAGIIAITPGSTNPQVTERGLSGMFRMCGRDDQQGVVAGDYIVNVLKAKKVAVIHDKDTYGQGLADATRAQLNKLGVKEVLYEGLTRGEKDFNALVTKIRASGAEVVYFGGLHPEAGPLVRQMREQGLTAKFMSDDGVVTDELATTAGGPQYVKGVLMTFGADPRLIPDGKAVVEKFRAGGFEPEGYTLYSYASIQSLAAAFNGAGANDPAKAAEWLKSHPVQTVMGKKEWDKKGDLKVSDYVVYEWDDKGKYHQLP

SEQ ID NO: 33032 - protein, 305 aa, Pseudomonas aeruginosa
KMDGIFLQQMINGLTLGSVYGLIAIGYTMVYGIIGMINFAHGEVYMISAYLSAIALALLAFFGLQNFPLLILGTLLFTVLVTCTYGWVIERIAYKPLRNSTRLAPLISAIGMSLILQNYVQVAQGPRQQGIPTLLDGALKFHVGDGFVQLTYTKLFILIASLIGMAVLTYVIRYTKLGRMCRATQQDRKMASILGINTDRVISYVFVIGAAMAALAGVLITMNYGTFDFYAGFIIGIKAFTAAVLGGIGSLPGAMLGGLVLGVAEAQFSGMVNTDYKDVFAFSLLVLILIFRPQGLLGRPQIAKV

SEQ ID NO: 33033 - protein, 718 aa, Pseudomonas aeruginosa
GDDDEQRDFHRSQAVRPRCRALRVDRPGGVRPHRRRGPRRLRLQPALRAGRLDHRDRDGRALPAHPLPADPRRARRAGALRGGWQRRPRPAAGLQDPLALDRAADPGGRGDLPVLRQQVPAGGGHPRPDLRAAGPGPEHRGRPRRAARPRLRGLLRHWRLWPGAGLPVPRPGLLDRPAAGRADRRGGRGDPRLPGVAHAWRLPGDRHPGLRRDHPPGTEQLAVLHRRAERHAGAGADLPRPGVRPPGQGWRGADPRVPRHRLQPQHEVPVHLRGAVPGRAAGALHQAPADPDAGRARLGGAARGRDRLSRDGPQPCAGETLGVHARRLHRGTGRGVLRQLPGLRQPVLVQLLRVGADPRHRRARRHGLYGRGGERRLRPHRGAGAAAQLRRHPRAAARDTHGGDDDLAGARADPHQPGGLRPAQGGGAMSDKILSVEHLMMHFGGIKALNDVNLDVERGSITALIGPNGAGKTTVFNCLTGFYKATGGNILLNTQGRTTDVIQVLGEPFQLDDFVKPPQLGSRLYYKMFGGTHLVNRAGLARTFQNIRLFKDMSVVENLLVAQHMFVNRNLLAGILNTPGYRRAESEALDHAFYWLEVVDLVDCANRLAGEMSYGQQRRLEIARAMCTRPELICLDEPAAGLNPAETHALSNIVRYLRDHHGITVLLIEHDMGMVMNISDHIIVLDHGDVIARGNPEQIRHDEKVIAAYLGADEKELS

SEQ ID NO: 33034 - protein, 355 aa, Pseudomonas aeruginosa
  UNSURE (320): Identity of amino acid at the above locations are unknown.
AAAAKNCSATRRCATPISADIERAPPRRSGRRGGRCPAATEETRLMHSLRFFSNAEVAERLSYPQLIEALRIGLAKPCSAPLRSCHALPAQASLLQMPVWQAGEGIGVKLVTVFPGNGARGLPAVAAVFALFDGEDGRPLALLEASELTARRTACSSALAADYLARDDARRLLVVGCGTLAAHMVRAHACVRDYRHIDIWGRDPAKAAALAARLREEGYPARAADGLRAAVEAADCVSCVTTSREALVRGAWLKPGVHLDLVGAFLPSMRETDALAVARARVVVDTRAGALEEAGDLLQAIAEGAIGREAISTELRDLLXGAGRRGDPGEITLFKSVGYALEDLVPARRVVDNAA

SEQ ID NO: 33035 - protein, 202 aa, Pseudomonas aeruginosa
RNTDEVNLMWDKRYAAEEYVYGTEPNAFLKEHAQRLAGPVLSVAEGEGRNAVFLASLGLEVLGVDGSTVGLAKARRLAEAKGVSIDTLVVDLADYEPPAAAFGAVVSIFAHLPSRVRGRLNRLLERSLRPGGLFLLEAYRPEQLGRGTGGPADVDMLVSRAALEAELPECEVLLAREIEREVVEGRFHTGAACVVQFIARKR

SEQ ID NO: 33036 - protein, 734 aa, Pseudomonas aeruginosa
SRIRRMQWIFMLVGLILGGFAGESLVGALLGGLSGLALGQAVSLQNLAQQNERLRKQMSEFAERFERGTEVIHQRLLRVERQAQDLPESVPEPAAGIDQPLADTPPAPPAEVAPPLDWDIELPAVEAAPPPPCPPEPVQPIERQPAFQPDAQPAPRRAAPPASPREPSLVERGFAAAKGWLFGGNTVLRIGVVLLFIGLAFLLRYASERVAVPVEYRYAGVALAAMALLGVGWWLRERRAAYGLILQGTGIAVLYLTIFAAMRLHPLISPGAALALLVVVMICSAILAVLQNAMGLAVVAALGGFAAPILTSTGSGNHVALFSYFALLNAGIFAIAWFRAWRPLNLVGFVGTFGIGFAWGLRSYTPELFASTEPFLALFFLMYVGIGLLFARRKLLEAAQAPAERGELLRWSARQADYIDATVLFGPPLVGFGLQCAVIGHIDFGMAFSALALGLFYMVLARVLRGHASAGRTSLLVEICLALGVVFGTLAIPLGLDARWTSAAWAVEGAGIYWLGLHQQRRLARLFALLLQGGAALAYLNGVRPGETTLLEGSPLGALMLGAAALFSFWQLRRAPAKALADWEPACRPLLAAAGLAFLYLVAPLCLAVDGTAIAWAVARPGELVRRLAPGLAYLPVLRLRRATAGRCAVPPAFAGRRWPGWGIRLGLAWLDDRLADWPGADRRHAAGGARPAGEGRQSAAHGLEPGAAGRSGVRQPGSAVRPALAQRQRGMGR

SEQ ID NO: 33037 - protein, 935 aa, Pseudomonas aeruginosa
RAADHLAEPGAAPAPELLLRPRLAGSGRPGVPPRRAVAVRLAERRRPAAPGPFRVLDAGSAGPGGAGRRLAAAPRRRARAGAGYRYPRPGRAVALAAALGSRLVGADRAVRNRPLRALWPARACVATGGRGDSGVVDAAGAARALARTGPAVPGAGPGGAVGPGQCLAFRLPAVRRIRLAGLAAAVRHALAVAATPCPVAAGEGPERCPCARLLAVARGAGAGAALPVRPARRTVQRLALAGLGVGPERLPAAGGWRAEPALAAARLPAGVSAARRCAGGAVAARLVLERQPAQRRRCRAAALPAAGQPAGTGAADRAVRPLPLERRQPGLARRWQCQRAPGAPGVGRRLAVRPADPGGVPRRAPPGRRTVPGRGAGRVDAGAGGAVAGLDALCAGPDHRRYPSRPARPVDGRRGAGRRRGGQAVLRRAGQQWQPGANHLLHRGRRPVAGRRLLLTLASASRRGRIGGRAAMTRSFSFRTAGLLLLGACLSLPLSAKESAEGFSRQVALSLQGEGPWYRLSIPMSVQLSAAHADLRDLRVFDAEGEALPYTLVAGSERQASTPHEAEVRLFPLRGTSAADATQPNLRVQRNTSGTIVEVLPENAGPAAETLRGWLIDASAVTFPLERLRLDWSSPEEGFQRFSVEASDDLEHWQAWGDGQIARLTFNGERIDVSEVKLPGRQARYLRLAWPAGATAADLQGARLQGSTRSTEPAPMIWSEPLAGRQAGDGEYRWQLPLALPLQRVRVSLQQALTHTIVPVELSGRDRTENASPRREAAWSSLARGVLYRLPIDGRNVQQNELELPGWAVRELRLQVDQRGTGLGPEVPSLSVGLPASELVFLVRGSPPYRLAFGKPGAQSAALPLGVLIPGYTESKRATLGSASLGEPLEVAMAVAAPAPGSDWKKIGLWAVLLLGVALLVIMAMSLLRSSPNKP

SEQ ID NO: 33038 - protein, 683 aa, Pseudomonas aeruginosa
AGSALCCSAEEALRRAPGRMPTTRRPDNKNKSRSKRMIRMALKPLVAACLLASLSTAPQAAPSPYSTLVVFGDSLSDAGQFPDPAGPAGSTSRFTNRVGPTYQNGSGEIFGPTAPLGLGNQLGIAPGRPGCLDFAGQRPSRASADGNNWAVGGYRTDQIYDSITAANGSLIERDNTLLRSRDGYLVDRARQGLGADPNALYYITGGGNDFLQGRILNDLQAQQAAGRLVDSVQALQQAGARYIVVWLLPDLGLTPATFGGPLQPFASQLSGTFNAELTAQLSQAGANVIPLNIPLLLKEGMANPASFGLAADQNLIGTCFSGNGCTMNPTYGINGSTPDPSKLLFNDSVHPTITGQRLIADYTYSLLSAPWELTLLPEMAHGTLRAYQDELRSQWQADWENWQNVGQWRGFVGGGGQRLDFDSQDSAASGDGNGYNLTLGGSYRIDEAWRAGVAAGFYRQKLEAGAKDSDYRMNSYMASAFVQYQETRWWADAALTGGYLDYDDLKRKFALGGGERSEKGDTNGHLWAFSARLGYDIAQQADSPWHLSPFVSADYARVEVDGYSEKGASATALDYDDQKRSSKRLGAGLQGKYAFGSDTQLFAEYAHEREYEDDTQDLTMSLNSLPGNRFTLEGYTPQDHLNRVSLGFSQKLAPELSLRGGYNWRKGEDDTQQSVSLALSLDF

SEQ ID NO: 33039 - protein, 200 aa, Pseudomonas aeruginosa
YPAVTRRPVDRHTLPIRFVRGNRPMSFNTEVQPGICMEPDAITQEYVFNHTMLRVKDPKRSLDFYSRVLGMRLLRRLDFEEGRFSLYFLAMTRGEEVPDAVDERQRYTFGRQSVLELTHNWGSESDDSQYHNGNQDPRGFGHICFSVPDLVAACERFETLGVNFVKPLDRGMKNVAFISDPDGYWVEIVQASLNGEMGCG

SEQ ID NO: 33040 - protein, 374 aa, Pseudomonas aeruginosa
TAPPPPISNRRLRGVKRDRQFRVKLRGFFPLSGAIHVPRYPEPLSDRADPQPQHPGRPALPHRGRGACLQGNQPCGVQGRAGRRARQHGHRERAGRGAEEAGRDVQRDPAGSQRMGRQPGRHGLRGDGPPLPDSGALSERRLPVGLRPAGRLQQHRRQRLGRHHLLGAALPQRVPEPERYPARGSLPPAGHHPGRRRLRHLRPADHADADPRQWRQGLHPGSRAGQLRPHPRQHQRAGKHRRVRHQHVQPAPLGSAGETLRGRTAGRQGRPAGQELQHALDRLDGRRRPPHPDPWRRLHVPARRPRAGEARQAAPDVRSQPDVVHHRAGRRRRHQRHPAHPRHQAGEPAPACRGVPRLEAGSRAHHRLPRGVGR

SEQ ID NO: 33041 - protein, 262 aa, Pseudomonas aeruginosa
THFIDASTRSLSVTSSSSDRSPLASQLGEVPAPLYARVKQMIVSQIQSGAWPPHHRVPSESELVSQLGFSRMTINRALRELTSDGLLVRMQGVGTFVAEPKGQSALFEVHNIADEIAARGHRHRCQVITLGEEVAGPERALALDVREGQRVFHSLIVHYENDIPVQIEDRYVNAAVAPDYLKQDFTRQTPYAYLTQVAPLTEGEHVVEAILAEPAECKLLQIERGEPCLLIRRRTWSGRVAVTAARLLHPGSRHRLEGRFSS

SEQ ID NO: 33042 - protein, 281 aa, Pseudomonas aeruginosa
SACLYGGWALLASQYERWGWPVLAGLVPFASLYMSLQHELIHGHPTRWPRFNAMLGYLPLAVWYPYPLYRDSHLRHHLDEQLTYPGLDPESRYVSLSEWPRLGSWRRRWLCLDKTLLGRATLGPLLALAAMARLEGSRLRRGEGAAWRLWGLHAVLLGGLLAGLWRWAGIPPWLYLPAVAYPALGLSMLRSFYEHRPAHEPAQRSVLVEAGWPWRLLFLNNNLHLVHHDLPGLPWYLLPRVYSASRRAYRRRSGDFHLPGYGRLWRRHGWRPVDAPVHPEH

SEQ ID NO: 33043 - protein, 271 aa, Pseudomonas aeruginosa
RQADESMIDTPVVAALDMYVEPDCVRQAGAIFIGEVCRRLGVRRYASAATDLAVQWRQPNLLFAQTCGYPLMTQLRGQVAVLAVPSYDLPDCAPGEHCSLFVAAEGQARQRLGDFRNTRLALNDHDSNSGMNLLRHALAPLGRDSAFFAEVHISGGHLRSLAMVAAGEVELTSVDAVTFGYLQRHAPERLAGLRVLGRSAPSPALPLITSLHWSAAQRRELFEALNLTLIECPHLAATLALKSFLPAGEEHYRILLDYERQAQGWGYPQLR

SEQ ID NO: 33044 - protein, 390 aa, Pseudomonas aeruginosa
NPRPARHYADRQELADRSAAAHADEQPRPGGRGEPQGTGGLRRHRPCRAQLGVLRQDRRDPQATERRRDPAGTVRQAGRRVQDPRQRAAGADRQLQPGAALGDLGTLQRTGRQGPGDVRPDDRRFVDLHRQPGHRPGHLRNLRRGWPPALRRQSQGPLGAYRRPWRHGRRPAAGGDPGRRLFAEHRVPAEPHRLPPAQSLRRRAGQGPGRRPGADPALHRRRQGHLHRPAGQCRRDPSGTGSPRRTPGHGHRPDQRPRSTQRLPAGRLELGRVPRPRADRPGRRGQGRQAVHGGTRAGHAGVPAAGRADLRLWQQHPPDGQGRGGGQCLRFPRLRPGLHPPAVLSRHRSVPLGRAVGRPAGHLQDRRQGQATDPRRCPPAPLAGHGPRAH

SEQ ID NO: 33045 - protein, 565 aa, Pseudomonas aeruginosa
RRGRRTHRPRADQRPGYRGDAARRRRLPGRHRLREGAGPEPADDHRPALTSKTASTPAGRGGGRPLSRPGHNKNGGARAAAEYSSMTQGSDSKPLIERRSIDYIPANERHGRLYSQFTLWLGANLQITAIVTGALAVVLGGDVFWSLVGLLIGQLLGGAVMALHAAQGPRLGLPQMISSRVQFGVYGACIPIALVCLMYLGFTATGTVLSGQAIGQLTGLSDSTGIFIFAAFIVLVTVLGYRVIHIIGRIASVLGIIAFAYLFSRLMLLSDIGDLLAIRHFSWASFLLAVSLAASWQIAFGPYVADYSRYLPASTSSWKTFLAVGLGSVLGAQASMVLGVFSAALANGQFAGREVAYIVGLGSSGTVAALLYFSIAFGKVTISTLNSYGSFMCIATIISSVRGQLEITRVQRLFFVLAIVGASTLIALLGQHSFLAAFKSFILFLLTFFTPWSAVNLVDYYFITRERYDVPALADPDGRYGRWNLPGIAVYTLGVLVQMPFLATTLYTGPMVEHLGGVDISWIIGLLVPAVLYYLVARRKATRQAPARMILPADPGAFERPAHGA

SEQ ID NO: 33046 - protein, 515 aa, Pseudomonas aeruginosa
DEFPGRRGRLQSHETPPADGAAEPAEPNKEPSMSLHLKPGQLTLADLRQAYLAPVRLSLDPSADALIAASVACVENIIAEGRTAYGINTGFGLLASTRISPADLEKLQRSIVLSHAAGVGEALDDAMVRLVMLLKVNSLARGFSGIRRKVIDALIALINAEVYPHIPLKGSVGASGDLAPLAHMSLVLIGESRARHRGEWLPAAEALAVAGLEPLTLAAKEGLALLNGTQVSTAYALRGLFEAEDLFAAATVCGGLSVEAMLGSRAPFDARIHAARGQRGQIDVAAAYRDLLTASSEVARSHEKCDKVQDPYSLRCQPQVMGACLTQMRQAAEVLEIEANAVSDNPLVFAAEGDVISGGNFHAEPVAMAADNLALALAEIGSLSERRISLMMDMHMSQLPPFLVANGGVNSGFMIAQVTAAALASDNKALAHPASVDSLPTSANQEDHVSMAPNAGKRLWAMAENVPRDSRRGVAGRLPGPGLPRGPEEFAEAGAGSPPAARQGAVLPGGSLLRP

SEQ ID NO: 33047 - protein, 281 aa, Pseudomonas aeruginosa
YRGRQPVARQRLPERAAAGPAVAESLIPAPGRSAGALQQEQQEESRGMTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIFAMILPGLGILFFGFSLGGGGDSRHRRAQPLAARRVPAQRLGPGWSPPCRWWYSPSAASRSSASPPARRRTRSG

SEQ ID NO: 33048 - protein, 281 aa, Pseudomonas aeruginosa
STASPRPMAVPGTRRANERCADEQDRSEERVQDLRPARRCRAGPYPPGTQQGRSAGADRLRGRRQRPVADHRCWRDLRDHGPVGFRQVDPGAPFQPPDRPHQRRDPGGWRGHPALRHGSPPAIPPAQDQHGVPEFRPAAAQERARQCRLRPEGSRRKPGAVPRAGPALDRHGGPEGLREVLSAPAFRRHAPACRPGPRAGRRHRDHSHGRGLQRPRPVDPRGHAGPVAGTAENPAQDHRLHHPRPRRGGTHRQPHRDPQGRPTDPGRHATGNPPPAGRRLR

SEQ ID NO: 33049 - protein, 520 aa, Pseudomonas aeruginosa
PLRPAAGGEPMSDLPSVVFGDGPLRWQELVAVARHGARLELSAAAWARIDNARAIVCRIVANGERAYGISTGLGALCDVLLEGEQLAELSRNTLLSHACGVGEPLRDEQTRAIICAAVANYSQGKSGLDRSLVEGLLALLNHGITPQVPAQGSVGYLTHMAHVGIALLGIGEVSYRGSVVPAAAALAAEGLATVRLGAKDGLCLVNGTPCMTGLACLALDDAQRLAQWADVIGAMSFEALRGQLAAFDAEIVALKPHPGMQRVAVNLRALLAGSQVLENARGIRTQDALSIRSIPQIHGACRDQLAHAARQIETELNSATDNPLLLGTPEAYRVVSQANPHGESVAMAADLLAIAVAELGGVAERRLDRLVNPLVSGLPAFLVGKPGVNSGMMITQYVAASLAGENRQLAQPAVVDNFVTSALQEDHLSLGTSAALKLGRALENLRRILAIEYLLAAQAFEFLAPQRFGQGTAAAWGILRERVPAYDTDRWLAPDIASAAAILGERKSLARLAASIGDLQ

SEQ ID NO: 33050 - protein, 103 aa, Pseudomonas aeruginosa
RRWRSSPATASTWPASARCYESSAASANACRRPCAAPAWPPMRYRRNTPGAPTTTSSISARRCSPRWPERDWWTRWTPSASTWRFPRRRSSGYSSPPASWACR

SEQ ID NO: 33051 - protein, 331 aa, Pseudomonas aeruginosa
PRRRRWPVSPCTPPGRWGWKPVTAAWRSASWPTSSPGTSSVRRSWPTGWAAICRNASFATPRRYTVDEVLSFKRGRVPLLISMPHPGTRLTPAVDAGLVEEARALTDTDWHIPRLYDFAEELGASTLAAHYSRYVVDLNRPSDDKPLYSTATTGLYPDTLFDGRPLYREGMAPSAEERMRYLAEVWTPYHRTIAEELARLKAEFGYALLWDAHSIRSHVPHLFDGRLPDFNLGTNAGASCDPALAARLEAVCAAAEGYSHVLNGRFKGGHITRHYGQPEQHVHAVQLELAQCTYMDEQAPFAYRADLAEATRAVIRELLESLLAWGRERYA

SEQ ID NO: 33052 - protein, 790 aa, Pseudomonas aeruginosa
MFAPANQTHFSLRIENLRHDFQVLAFRGREAISQPFRFDLELVSERSDLDLDALLHQPAFLILSPSGQGVHGQLTSIAQGDSGKRLTGYRATLEPRLAYLGLCSDQRIFQRLSVPEIIGRVLEGHGILADAYRFQLGPTPYPAREYCTQYDETDLAFLSRLCEEEGIHYHHEFSAQGHVLVFGDDQTSFPRLQRPVAYVQDAGLVADQPVVKRFGVRFDTRASRVTRRDYDFEQPALQMQAAHGPQPGAQQPDLEDYDYPGRFTHRERGKHLSRRALERHRADYLQARGESDEPALLSGHFLTLSAHPRGEWNDLWLLTEVLHEGRQPQVLEESIDSDVAQGRGDFRQGYRNRFVATPWSAHFRPPLEHPRPRLLGCQTAVVTGPAGETIHCDQYGRVKVQFFWDRLGQADDNTSCWLRVASNWAGKRYGGVAIPRVGMEVLVGFLEGDPDQPLVTGCLYHSENRVPYELPQNKTRSVFKTDSYPGGGGFNELRIEDRKGQEQIFVHAQRDWDENIEHDQKIRVGHERHDTVEGDSYSEFRAEEQRTVHADRKVELKAADHLSVADALHLRIGTGQFVEAGDEIHFKAGDKVVIEAGMELTLKGGGSFARLDPGGVTLDGAQVMINSGGSPGIGSGVRALSPLQPLAADAAAAGGALLGAIAQKVGEAPQKLLRFELSPLPGVPSAARQPYRLYANGAFKEEGIADEGGAISFEPLPGERTYRIETANGHAYEVEMVDQPDALQADDRLAQQGFRDYRAEMPQHKPRSAPDAYRRDASRPGAADKDEPTP

SEQ ID NO: 33053 - protein, 217 aa, Pseudomonas aeruginosa
SMARRPSTRCMRRWRRPGTASTSSPGASTRPCVSNAPTDRESANCCRRRAAKECRRECWSGATNSPGSRKTPSPGPASAVPAAPGRARASPAAARWTTRCCDWSSGASITSTSSRGSRKPWSARNGCTAKAGCRASTRGAPPTRGRASPSWRRRTPRSSALSTAARPRATAASAVPAAPARIPGGRYSPATGSRRYAAVGCRTSSSVPATSSRRPDR

SEQ ID NO: 33054 - protein, 314 aa, Pseudomonas aeruginosa
PLATPPRPGLRRSSTRLEAGSVIRLMAIGIWAVLCLAAVPAMADSKPFVCVNEKDHLPPLDPQADAWYREAATLAKPDTLRPWPRIVGLYSKAAERGHWKAMHNLANLYRTGWPGGVEKDTQKALDLYQKMIDLDVPQGFYDMGAMIGNRAGVKNPATDGLTFLDKAASLGNPPALTELGKLYIYVAKKKDLGLAYTHCAASQGHAPASYELGAYYKIVEHNFPKALGYYQASVSQGGKSAALFISGVFDKASPDVDRMWYAPDEKLHKLYDGIYDQLAADPDLRFPNLIKDHPLPPHPTQGYDVDRPDWKPER

SEQ ID NO: 33055 - protein, 448 aa, Pseudomonas aeruginosa
PGFIPWPSLFIVLPLSSAPIVEVLENTWITIVMAQRVCIIGAGVVGLATAYALVREGFDVTLVEARERGGLETSYANGGQLSYRYVAPLADSGVPAQALGWLLRNDAPLRLRPRLDPAQWRWLLGFLAACRGSLNRRNAAHLLRLALLSQRTLQDWREEDGLDGFDWRRNGKLVAFRQPASFARARQGLADPSAQFVLTAAECLALEPALSAAPFVGGIHTPDEEVADCHAFCVQLAERLQASGHCRQLHGRRVTKIVEGGAAVRGVEVGGDLIEADHVVLAAGYRSAELMLPGLRLPLYPLKGYSLTLPVGAQHRAPDTSITDYDRKIVYARIGERLRIAAMVDIVGFDPGLEPARLALLRQQARDTFPQGGDFDAAVEWAGMRPATPTGVPLVGNGGYRNLWLNLGHGALGFTLACGSGRLLAEQIGRRPPSIDTSGLLPRGALAG

SEQ ID NO: 33056 - protein, 415 aa, Pseudomonas aeruginosa
MSPPTSWRTSRMRCSTTSRPAARIRCRKASAMLVLPAPGAVAWIDGFPSTGADMKAARFFSRRRSIMRGRAKDGPRCRRLRRGPNTSPRERIMLVLYPEIKPYARHELAVDEPHVLYADESGSPDGLPVVFVHGGPGSGCDALSRRFFDPNLYRIVTFDQRGCGRSTPHASLEKNSTWELVADMERLREHLGIEKWVLFGGSWGSTLSLAYAQTHPERVHALILRGIFLCRPQDIHWFYQEGASRLFPDYWEDYVAPIPPEERGDLLAAFHKRLTGSDQIAQMHAAKAWSTWEGRTATLRPNPMVVDRFTEPGRALSISRIENHFFVNQGFLRPNQLLEDMHRIAHLPGVIVHGRYDAICPLDNAWALHQAWPNSELQIIRDAGHTASEPGIVDALVRATNEIGRRLLDLPPEAE

SEQ ID NO: 33057 - protein, 871 aa, Pseudomonas aeruginosa
AKPGAISCLPMNNPSTTKAPLADYLAHLPLAEEERERLGESASFSELHARLAGAEGAAADAGGDPALASVRARLQLGTPELDDAEMFGVDAQGRTFLKISPPIRRTKVIPEPWRTNILVRGWRRLTGRSNPPKPKRALPRARWQRVGSLRRFILLLLMLAQTSVATYYMKGILPYQGWAFVDLEELAQQSLLDTVQQVLPYVIQFGILALFAILFCWVSAGFWTALMGFWELLTGRDRYRISGSSAGSEPIAADARTAIVMPICNEDVPRVFAGLRATVESMAATGEMERFDFFVLSDTNDPDIAVAEQQAWLELCRETKGFGKIFYRRRRRRVKRKSGNIDDFCRRWGGDYRYMVVMDADSVMSGDCLAKLVRLMEANPEAGIIQTAPKASGMDTLYARMQQFATRVYGPLFTAGLHFWQLGESHYWGHNAIIRMQPFIDHCALAPLPGKGSFAGAILSHDFVEAALMRRAGWGVWIAYDLDGSYEELPPNLLDELKRDRRWCHGNLMNFRLFLVKGMHPVHRAVFLTGVMSYLSAPLWFFFLVLSTALLAVHQLMEPQYFLEPRQLFPIWPQWHPEKAIALFSTTLTLLFLPKLLSVMLIWAKGAKGFGGVIRVTLSMLLEMFFSVLLAPVRMLFHTRFVLAAFLGWSVQWNSPQRDDDATPWSEAIRRHGMQTLLGIAWTLLVAWLNPRFLWWLSPIVGSLILSIPVSVISSRVKLGLRARDEKLFLIPEEYDTPRELRATDEYTYENRWHALKDGFLKAAVDPLLNALACAMGTARHNRAQAIETVRGERIGKAIDKGPEQLDGATRLALLSDPVALSRLHTRVWEEDRDDWLGRWRKAEADDPHAASVPLAQVVPGDAGLLPAAQS

SEQ ID NO: 33058 - protein, 345 aa, Pseudomonas aeruginosa
SHAPGGTPPGAWSVSCLFSPCGAAVTLRRQSRKSRIVRQLRYYRPPFAQPVMACCPPGTATRREHPFDDCVSKTAGDWGMKKYLASLVLGVCALVGVASVQAAGAVEDAVKRGTLRVGMDPTYMPFEMTNKRGQIIGFEVDLLKAMAKSMGVKLELVSTSYDGIIPALLTDKFDMIGSGMTLTQERNLRLNFSEPFIVVGQTLLVRKELEGKIKSYKDLNDPQYSITSKIGTTGEIVARKLISKAKYHGFDNEPEAVMDVVNGKADAFIYDSPYNVVAVSKFGAGKLVYLDQPFTYEPLAFGLKKGDYDSINFINNFLHQIREDGTYQRIHDKWFKNTEWLKEME

SEQ ID NO: 33059 - protein, 119 aa, Pseudomonas aeruginosa
PATGPPAHCSGACGPPSGYRWCPVPSVWLSAWSPASAGCRRTRPCTACRRSTSSWCAARRCWCRSSSSTSSSAPCSTCPASSPGLRRWRCSPAPTWPRSSGPACSPSPADRTRPPAPWA

SEQ ID NO: 33060 - protein, 261 aa, Pseudomonas aeruginosa
TCPFRTWHPDWSGGSDKVIEVRNLLKVFDTRGQVVRAVDDVSTRVARGEVLVVIGPSGSGKSTFLRCLNGLEEFDEGSVSIDGVDLADPRTDINAYRREVGMVFQHFNLFPHMTVLENLCLAQRVVRKRGKAEREAKARALLAKVGIGQKADEYPSRLSGGQQQRVAIARALCMDPKVMLFDEPTSALDPEMVGEVLDVMKTLAVEGMTMVCVTHEMGFAREVADRVLFFDHGKLLEDAPPAQFFDNPQDPRAQAFLRQVL

SEQ ID NO: 33061 - protein, 539 aa, Pseudomonas aeruginosa
TACGSAARWRASHRRAALPPRGGNPASVPATGWCSAGRSAAGVPARFPAMRPVRDRAPRRRSAAPCRCTGRGSGRFPGYPGRRPVRRYRWSSGAWRHLPKGESLILRKGAPPVRFRWTGGAADARRILSGCYRRKRPTCACNCVPRRASSPLEAAVCSLAAADCSATSRTLRTLRLISSATVLCCSAAVAICRFMFWMSETVRVMLSSAAPARRASSTVLAVSERLFSRRSAASPAPCWRRWIRPSISAVDCWVRWARPRTSSATTAKPRPASPARAASMAALSASRLVCSATDLITSRTLPICSLSFFRRAMASLETSISLARRSMRVTAWSTTASPWRASSSAWRAAWEASSALRATSCTVAAISCMAVATWSVSTFWLLTPARVCSVTAESSSAELANWLTPSPIRPTSSRRLSPMRCMTRCNWPSSSRRWRVRGFCGRLPRSPAAMASACARASSSGRTICRLIAQPATQPKARASAAISQRLARSRLAVLSRNWRPASVRVRPARAISWVLLCIACCAWRVRMTPARNCSIPPR

SEQ ID NO: 33062 - protein, 390 aa, Pseudomonas aeruginosa
WLSVVASGVRARRAGTWPAGEVLWLSCGALRDRGCRPGGENLQSFTGVFSEQPRKQGADRGFHAQDAFAELHRMQSGFAQLVDLVGNPAAFRADRQGHRLLHRARTGRPGTGMADQAEAAGGQGRQAVFDEGFEALLDDDFRQHRIAGLLQAEDQVLADRRRVEERGLPEALFHAVAVQQHQLRYAHRGDGLQHPAEHLRSRQGQQQGDRQLGRRRLVKAHFQGRLAGVELQQATFAHPAAEAADPQGVAVLGAVHFVQVLEAAIVQDRTIRRHEVGVVEEQQVHWRVAGGWSPSLAGWSSGCSPRLRTRRPNSRPISNSSHIGTASMVWEKMSGGVRTMPTTKQPMITYGRIYFRYSTSTTPIQISSTVATGISKATPKAKNRVRTKSR

SEQ ID NO: 33063 - protein, 518 aa, Pseudomonas aeruginosa
QAFEGVAGHLRQVRHLLDLLLEIAQQLLRADPFAHPALQERLGGGPQVEFRVELAAEAFDVQQGLLQQHQLRLDLHVETTRGLEQAQQDLAEGDVLQRLLEDRFADGADRRLEVVDLGFRRYPAGVDMQLGDLAVVALEEGDQVARQVVLVLVGQAADDAAVHRDVLRAPGRAGADEDVAGVHVGMEKAVAEHLGEEDLHAALGQCLEVGALVAQGFQVGHRDAVDALHHQHLGPAPVPVDLWHVEQRRAFEVASQLRGVGRLAEQVEFVDDGLLVVADHFHRVQAPRLAGDPLGEAGEDEQPGDVGADHRFQVRPDHLHHHFLAALQARGVDLGHRGGGQRFAFEAGEDLFDLRAQLFLDALDRQLRREGRHLVLQPGQFVGDVVGQQVAAGGENLAELDEDRSEVLQCQAQARAAGQFQLAPRQPAPGQGGTEQAQPPGQHRQFEDQVVQAVADDDALDAQEAADSEELHASGLVFWLRRPTRASRRSRASFSWSSSAKRASASCWPTSVRLSSAR

SEQ ID NO: 33064 - protein, 436 aa, Pseudomonas aeruginosa
PSRSRNSPASASSRRRRQRPSLRRNRLPSPRRKPQRPSRQLNRQPRPPPSLRRNPRRKNPRRKPRPPSRQPSPPPNRLRRPQRNRRPSRQPRPRRSLLRNLPQPSRPLRPPPSPRRNLPPSRLRKSLRRRSRQPSPPRRNRPLPPRLRARPLPPPPHRLPALRQRTLRRRRAARAESWRQGTRPALAGRFSFRSQVALRQAFRRALGLAAQMRGDQHHDLVDHRAHLALAAQYPLIIQGEQQGQGDLFDQLPECRRVAAQLPVGLEAGQQGGQGPLQRAEPGTDAASQPWQAPGQVGQVLEQEAVVGEALDDQVQEQPVVLRAQAHLLGRIEQRRQLGLEPLEQRHHQRFLAMEVVVEIARADAQFVGDLQCRDVGLALFVEQQQRAFEDSVACLHPDFFWGWRCPAPGARAGSFSVYARRCPGPLRGADARRCQG

SEQ ID NO: 33065 - protein, 574 aa, Pseudomonas aeruginosa
RSAAECFLPCPAALRCGWSGRRGRWSGRRRAGACSGSSAAQPRARRYGAWPASARHGAAPEALAGFRRRRPRIAPAAVLQAGRFSSFMHVGSGRGFAGRIGLVAQAGGRLAGLAGAFGQPLLPVQPPRVGVLAGLFQPGLGLGGQFRIGHEACLGVARWVEDALDVTAVGEDELALATQQPGRLVARLPGGDVVVQTGDTVEVASHLLQVDGRAGDLQGAGAVQRVALEQFDELAVQRGGQARGVVVPVEDVERRRLVAEQVVVDPVVPDQVVGAHPGEHLGHVLALQHAGLVGATLGGLQGLLVGEQRDLGIQFEVEHADQLGEGVDLLLAAGHVVADQGRGGDPAGAGAEEVEVLAAGDRQDYLDGLLERLDIGGQAPFALRLGRVAPADDEGLHAVAQAEARQALVRRQVEDVELVDLRRHHQQRAFVHRLGDRPVLDQFQHVVAEHHGALGGGQVLAHLEGVHVHLARHPAVVHQVLGQVAEAVQQALAAGLEEALDRRRVAQAVGRRHRLGQQVDDELATTDVLRRQVAVADPAVQLLAPGQVGLHVALVQWILAPGRIGKASVVIAWA

SEQ ID NO: 33066 - protein, 337 aa, Pseudomonas aeruginosa
PASIRIGLSLCSLARSAALNETSSSSRSSSVCRRRAPMFSVFSLTCQAISARRLMPSSANSMASPSVFSNSRYCSVSEACGSVRMRSKSFGLRALSSTRIGRRPCSSGTRSLGLLRWKAPEAMNRMWSVLTMPSLVFTVQPSISGSRSRCTPSRETSAPPALARLAILSISSMKTMPCCSTASRARALSSSSLTRRTASSSRISFRASATFSLRVFFLPLLMPENRFCNWLVISSMPGGAMISTPAGLSATSMSISLSSSWPSRRRLRNSWRVLLSSRAGSSPKPMAGRAAGSRASRMRSSAASSARYLTFWISCSRSIFTAASARSRMIDSTSRPT

SEQ ID NO: 33067 - protein, 327 aa, Pseudomonas aeruginosa
PTSVNLVASTLMNGAFARRARRRAISVLPTPVGPIMRMFFGVTSARSSAGSCMRRQRLRRAMATARLASSWPMMWRLSSWTISRGVMDIRLLQRGTSASDGAVQLLDGQVLVGEDADRAGDVQRGLGDFPSAQLGVVLQQGQGRGLGEAAAGAHGDQAVFGFDHVAVAGDDQRGILVGDREHGFEAAQGAVGAPVLGQFDGGADQVPLVFLQLLLEALEQGEGIGGGAGETGQYLTVIQAPDLLGVAFHHGVAQGNLAVAAHDDFAVAADRYDGGQGGNLHTAGPNARNAGRYRGDPRLFNRTHRRASERTAWPAFSGPCVAVTAGC

SEQ ID NO: 33068 - protein, 135 aa, Pseudomonas aeruginosa
SARARGRRRTACGTSRPAGRTACWRRPPLSAAAVAPARRVRPWPALRRPWPVRRGWAAAGPSPVPLPAAPRPRTPAAGCRTRTSAWPGPASAFARAAGPGRSAAAACPARRRPGAGRPGVRAGRPCARVRASSGT

SEQ ID NO: 33069 - protein, 72 aa, Pseudomonas aeruginosa
IMKADIHPTYEAIEATCSCGNVIKTRSTLCKPIHLDVCSECHPFYTGKQKVLDTGGRIDRFKQRFGVFGATK

SEQ ID NO: 33070 - protein, 154 aa, Pseudomonas aeruginosa
HGTGSRWSRRSVPGPRRLRSDGDDPGGAGAEEPGGLRSRRGCAQWPGGTGRRLPRVVRYPSGQRPASAGSGRPGPATGQRTAGSGARGLSSPSGRHAVRRLGIGRGASRAELLPCRAGLHPELSGGLEDPQPAQCPAWLSGGRAVVHRHEAGAP

SEQ ID NO: 33071 - protein, 759 aa, Pseudomonas aeruginosa
NRWTTSSTADRSIRRIKRNPALAGFLFACASRSRRRQRSAGAGSEQVDRRAFVIRQRAAREAAWRQFVDRGRGVLVLEHLEIGAGSARRGRTAGHRVDAQADDAWRFGHGVHRLVLEGEAHVPDPDRQRDGTAVLAATQGLRLVEADPDAGHVVGVVAGEPAILGIVGGAGLAGQVGALQRQGATPGTALDHVLQHAGHDIGGTGIDDPLGRGRLEGGLGLGGDLLGFDRTFAFGALRMLGVTRIPGVFRIRRSDLFFHRHAGRIGLVQHLSVAALDAFDDVRIDLVAAVGEYAPGAGDFHRCDCRGTQGQGEVARQFVALEAELGDVADRPLDAQALQDADRDHVAGLVQGFAQRDRAEEGVGVVLRSPDLVQVLVDEHDRRIVDQAGGGEAVVQGRAVDERLETGARLALGLDRAVVVALLEGEAADQRADRPVLRVKGDQRALCGGNLYEAQGAVFLALHADLVAGLGHVGGLARHRAHAVVAEEGACPFHAVPGHGFFLAVAGHHHDPALFHLGDDRRLQAADAALLAQVLEPGVAGLARQAGLRAAVAVALVIVDEAVADRLAGGVLQVAADRGDDLVALGIGLAAVAADHLGTGHLGDVGRIQFGGLHVVGGVDRLLDGGLVALLVDEAELEHALEDPVAPLRTAGRVDQRVVARGRFRQAGDHRHLGQAQVFDRLAVIDLCGSLDAIGTVAQVDLVDVELEDLVLGQLSLDLQGQEDFIDLSREASFIGKEVVLRYLHGDGAAASLDVTAFQ

SEQ ID NO: 33072 - protein, 298 aa, Pseudomonas aeruginosa
LRQRSSASVQGRRGAAGFPLAAVLLRRRTVQRRRLHRPGGRYGVYPGSRSVDPAEDRHPDPGRQPVRRHGAERQGECRRPGQRRSGVDDRLRPGVEEFRLMARINLLPWREELREQRKQQFLVILGGVLVASAALVFLGDQYFTAAIENQNARNDFLRKEIVVLDARIKEISELKSRRQQLLERMKIIQDLQGNRPIIGRVFDQLVRTLPDGVYFTDLKMTGKNIAIAGAAESNNRVSNLMRNMDASEWLTAPTLNEVKAVTQGAVDQANVFQLTVQQTQPGEEDAKAKHGVAQGAKK

SEQ ID NO: 33073 - protein, 751 aa, Pseudomonas aeruginosa
RRGELAGASAQPDSQGTLLRAGKNMHNQQQSVQRSRTMNSGLSRLGIALLAAMFAPALLAADLEKLDVAALPGDRVELKLQFDEPVAAPRGYTIEQPARIALDLPGVQNKLGTKNRELSVGNTRSVTVVEAKDRTRLIINLTTLSSYTTRVEGNNLFVVVGNSPAGASVASTAPVKASPAPASYAQPIKPKPYVPAGRAIRNIDFQRGEKGEGNVVIDLSDPTLSPDIQEQGGKIRLDFAKTQLPDALRVRLDVKDFATPVQFVNASAQSDRTSITIEPSGLYDYLVYQTDNRLTVSIKPMTTEDAERRKKDNFAYTGEKLSLNFQDIDVRSVLQLIADFTDLNLVASDTVQGNITLRLQNVPWDQALDLVLKTKGLDKRKLGNVLLVAPADEIAARERQELEAQKQIAELAPLRRELIQVNYAKAADIAKLFQSVTSDGGQEGKEGGRGSITVDDRTNSIIAYQPQERLDELRRIVSQLDIPVRQVMIEARIVEANVGYDKSLGVRWGGAYHKGNWNGYGKDGNIGIKDEDGMNCGPIAGNCTFPTTGTSKSPSPFVDLGAKDATSGIGIGFITDNIILDLQLSAMEKTGNGEIVSQPKVVTSDKETAKILKGSEVPYQEASSSGATSTSFKEAALSLEVTPQITPDNRIIVEVKVTKDAPDYQNMLNGVPPINKNEVNAKILVNDGETIVIGGVFSNEQSKSVEKVPFLGELPYLGRLFRRDTVTDRKNELLVFLTPRIMNNQAIAIGR

SEQ ID NO: 33074 - protein, 425 aa, Pseudomonas aeruginosa
WRCAIRSTAKSPMWWWRPTKGRRAWSSRKFSNACASCRPAEARRIALSYCPFLSGGLMRTLHVDLGERSYPIYIGENLLGDARWFAPHIVGRRVAVISNETVAPLYLETLLKALQGHEVTPVVLPDGEAYKQWETLQLIFDALLKERHDRKTTLIALGGGVIGDMAGFAAACYQRGVNFIQVPTTLLSQVDSSVGGKTGINHPLGKNMIGAFYQPQAVVIDTASLKTLPSRELSAGLAEVIKYGFICDEPFITWLEEHMDALLALEPTVVTEAIERSCAAKARVVGADERESGVRATLNLGHTFGHAIETQQGYGVWLHGEAVGAGTVMALEMSHRLGWLSAAERDRGIRLLRRAGLPVVPPAEMTAEDFMEHMAVDKKVLDGRLRLVLLQGLGNAVVTGDFPREILDATLRTDYRALADQLGDE

SEQ ID NO: 33075 - protein, 528 aa, Pseudomonas aeruginosa
GPMTSLHADEAFLGHYQFSHDPFAPRVPGFKFFPAQRKPVLGQLHHLARYSQLLLLVTGPLGSGKTLLRQALVASTNKDAVLSVVISARTAADETSLLRQVAQGLSINQASLEAILTKVAQLAITGQDVYLMVDDAEQLQDSALEVLLLLASGTNEGRLHVFLFGEPSLLPRLEVFSEGEERFHAIELQPYSEEETRDYLAQRLEGAGQGIELISNDLLVDIHEQSEGWPGAINQVARDALIEAMLANRGAARKATGGSFNLPKKHLVILAVVAIGVIAAWFMQGKSKPEAPQTASTELSMNGGTPAQAQQPGSGPAVEFNGSSQPLPLPLVGESQPVIREPLAQAAGQGGDDEGGLPFRRGAAYRFQLGSSRVTPLANNGVTPMHPGAPGPDRTDRPCGDPRFRGQAPDTGPGRSPRAPASKPAPAPFQAQAGGEQAGHHRRGGSRPRIRPPSRPAVAVREVSGIATSLVVTSPCRSSVPAPKPMPRRSFASRAAAISATSRKPCKASRSTSSPMAASRTVPPPWPQ

SEQ ID NO: 33076 - protein, 454 aa, Pseudomonas aeruginosa
LRIWPDRPYAGRAEPSTSANRNRSTDLHDPPRWDQCRWQDRGRLRAADPEARPVPACRRQGSLFCRPARAIRGGHGVLQPGPGESRGGTREHESRDRRRRTGAGRLAQGADRYQRSRPPGAGASAADRTGVHRRRRPERPGLRHQAVQRTAPLVGGQRRRQRPLHLQLFAQNHHLQGPDDAGRPGRLLSGPWRRAPADRDLRIPPALLHQHPAEMAAGAAVPLPRPQRRDQHHHRQPQLGPGAADQVHQRTDPRPGRARPAGEPRRLRLVEHGQHARTDGHRRHGPVPRPAHDHPAGLAERRNHGRRPARVLRVQLAAHGALGWPRRRRADRRSLCRLPARPQWPAPVALGHHEERLHHPGFGNRRLGLQARGRHRQGARRPGADPRGGHRDRPGPAQRRHRQPPEVAPSLQAVAAAECPAHPGDPGRRPWRGQLRRRPAQAIHEDVPGHLRGA

SEQ ID NO: 33077 - protein, 219 aa, Pseudomonas aeruginosa
PGAASARRAGPGSGGLHGRRYADGDPLPAHPLSVRLLPPAIRPGHQPADRPAARSHRDVPGNLPGRRAEHLRGSPAPCQPGDPHHSGDLAGEVADHHDPGPPGLRPPLHRPQLRRVDGPGGRGAQHRRPGRGGRARRQGAADPQRPPYRSRQTAGACCPGRRCGASPPGADRAALRLQHPGGDRHRPRSAPFRGADRLRRLGGLSVPRLRGAGRPDPHR

SEQ ID NO: 33078 - protein, 793 aa, Pseudomonas aeruginosa
SAGRPLRGVQVLPQGDLQGPDEDSLEDGHLHRRVLPWRAAVRGGGPVRRGHRPVLHRSRQPHPGRALRRYRERAEAPGRRGLEQPQADPAGRLAEVRLWRRIPRLQPGCGEYPAGCRAAGRLREVQGIHRAGGPAPSVDDPRPVAGEDRRAAAGARRGGAAGSHLQALRCRRDFPRRAVAGGPRGAGRGDEHPGRSLQLRRGRRGPGALRHAEEFEDQAGGYRPLRRDPGIPGQRRGPADQGGPGPPCPGEGGQLPGGKVNGLIARLRYAVPGVTLISPPPHHDIYSIEDLAQLIFDLKQVNPQALVSVKLVSEPGVGTIAAGVAKAYADLITISGYDGGTGASPITSIKYAGSPWELGLAETHQTLRGNDLRGKVRVQTDGGLKTGLDVIKAAILGAESFGFGTAPMIALGCKYLRICHLNNCATGVATQNDKLRKDHFIGTTAMVINFFTFIATETREWLARLGVRSLGELIGRTDLLEILPGETAKQQNLDLAPLLGSELIPADKPQFCEVEKNPPFDQGLLAEKMVELSKAAIEGLSGGEYELDICNCDRSIGARVSGEIARLHGNQGMAKAPVVFRFKGTAGQSFGVWNAGGLHLYLEGDANDYVGKGMTGGKLVITPPKGSPFKTQESAIVGNTCLYGATGGKLFAAGTAGERFAVRNSGSHAVVEGTGDHCCEYMTGGFVCVLGKTGYNFGSGMTGGFAYVLDMDNTFVDRVNHELVEIQRISGEAMEAYRSHLRKVLVEYVNETASEWGANILENLDDYLRRFWLVKPKAASLGSLLTSTRANPQ

SEQ ID NO: 33079 - protein, 180 aa, Pseudomonas aeruginosa
RRKHAGLAQGSEERQGRGREVPLQPPAHRHRRRGPGGRREGGRDPSRRAGRPRPPQPRTDPRFRGDHPGGSRADRLRLPAESGAVVRALRDRHRQPGPRGGSGAGAVQAPDQQPEDLRRWRHGPWFRPGGDGDLRRTYRGRRHPRLPWRLIRGATGAATNHRDRQKARPPPCLLFCALRQ

SEQ ID NO: 33080 - protein, 359 aa, Pseudomonas aeruginosa
SDAVMTALKNDRFLRALLKQPVDVTPVWMMRQAGRYLPEYRATRAKAGDFMSLCMNPELACEVTLQPLDRYPQLDAAILFSDILTIPDAMGQGLYFETGEGPRFRKVVSSLADIEALPVPDPEQDLGYVMDAVRTIRRELNGRVPLIGFSGSPWTLATYMVEGGSSKDFRKSKAMLYDNPQAMHALLDKLAQSVTSYLNGQIHAGAQAVQIFDSWGGSLSAAAYQEFSLTYMRKIVDGLIREHDGRRVPVILFTKGGGLWLESMAEVGAEALGLDWTCDIGSARARVGERVALQGNMDPSVLYANPAAIRAEVARILAAYGKGTGHVFNLGHGITPEVDPAHAGAFFEAVHELSAQYHG

SEQ ID NO: 33081 - protein, 428 aa, Pseudomonas aeruginosa
AGTKEGEPRLPFFMRGPTALRRVGWRGRAGGVPALRNPPGSTAYLAGAVVDHEQLAVGVAHEDFRARLAIHVGHRIDAVVDVADAVVAAGAAGVVDDPHLALHHHDQLVARLAVGVRGAAIECPGAGADVVFLAGTGVADHVDAGAGAADDLRAGLAVEVGDLCERVVAAEGEVLGATGARVDDLDAVAHVQHQFLARRAVHVGDVEQAPGAVVAEGGVALRTGAIEYGAHAVADAEDDFVAGDVVDVGGAHDRPGDVAYRVLALGGAGVGNDHQVGTGLDQDFRAGLAVGIGGAEDRPDHVAEAVVAGAAAFHHLQVGAVAVDRGELAVAPQVPGSYQNAGRLGCAGAEGEQCRAEQAGALDRWFHKVPFISLSRPAGCRPQQHRTALAALKGNARDLSSAWHLFVKLVARPAGGRGCRSAARRSSA

SEQ ID NO: 33082 - protein, 460 aa, Pseudomonas aeruginosa
WSVRRSPCGGSCWRVLARNDRQSGASASAAALAGAAILPGNAVKRRTSDASLGTTQHSTTGRAPGAGHRRQQRPGLAGGAHAGRQRGDRGDGLPQSRTGGAGAAGDPRRVSPGTPGAGRSRPGRPRLDPRLRRRFPSAPRTPRSLVQQRRSDVPAPAAYPRRFRDADGHQSPRPLRPYGTAAGVVAGRSTAQGGGHDQRFQPVRPAAARRPQRRARLQPLSRLLPQQAGQSAVQPGVAAPRRPAGRASAEPGGASGLRGDQPAVRGAGDGRFAPGTLGDEGGQRSVRAIGGDGGVAGTFRADRTALVWRRLCRPGSLVGNPRLSGGGADSAECARPGAGRAAVGAIGGTDRSTLLVGVKAPGDRRSNSVGGLRQGVARQGRQARQVQRDQYRDHQQRADEQPDAVPAVVMPEHPAEGAGQARADVVAEQVERRGLALGAQGAAPDPAARHRVRAEEAEGE

SEQ ID NO: 33083 - protein, 295 aa, Pseudomonas aeruginosa
QQAGEHQRDRLEQGQQQAAEHQQDDRPEHLASPQLVGQRTDPGRAVDAREVNHREHADHRLAHVVGLGQQAVADVVEQGDEAAHQQEADQEQPGQSGVAEVQAVAVEQGRRLQRCRPEVFRFGQHAPEHQRGDQGQAAEDRQCGMPGDEIDQDAADQASAHPADGVAADVQAHRQADVLRMDLFAEIGHRHRGQAAQGQPDQRAHQQHAMPGGHHRAAEGEQRGGQQRDDHHRLATDRVGDRAGDQQAKGEHGGGDGQCQAAFRGADGKRLGQHRHHRLDAVEQGKGGETAGEQR

SEQ ID NO: 33084 - protein, 510 aa, Pseudomonas aeruginosa
LEGPRGTQAPALFHRRRRGAALRPRRRAPGDLPAAVEPADPGAGGGNRCAPVRAHQPPRRTHRRRPAVPRRVPPGAGPGRQGGVAGASGPPGGTGRAEDRFHFLGTLHLDHTQQHPCLPQGLSGRTPRPAGNEQPPGTQGAARGKPAGGRDPPAGAAGCGALGGVVPRTAGGGAAGRPSAGGRQRGWPGHRRPGRGALRVLPAQLRHRALRPGHRPDPTGRLQPAHRPGGQRGDDHHRPGLGRTGGVDPAGVVPPHPGRRRGLPHPERSRGDDCGMAGPSAERGLAAGAVLHRPGDPRGGQPAPALNRSTSGPRRRSRLPAALPIIRDQARLTEISHAARGVQSERRGRQVQHRLQPGGGQRGGGLSHPAGGPGRPGQLHALPDRTDRRGPAGGDRRLLQADLVFRALQQEGQGRDLRDAVRQPAHRHLQPRTGRPAAEAGVEAQDQQAAQTAGRTGRRLRPDLPGYPAGTEFLHGICADRCRSLPDSLRLRQLLPPGAVWPSPGDRGTA

SEQ ID NO: 33085 - protein, 157 aa, Pseudomonas aeruginosa
PGSRTSALSPLRWTKAIFSSVRCLASSVGSGMALSMSGIPARLAGRPGRARTETLARTDRSAQRAAAARAWSRSARMSSMCSMPIDSRTMSSETPARASSSAFNWRWVVLAGWQARDLASPMLTSRTTSFKASMKRAPAALPPWMPKDRIAAGRPPR

SEQ ID NO: 33086 - protein, 176 aa, Pseudomonas aeruginosa
RRFHSSAAISRNSGRNSSGRSTRPSPSSRTPEPQGISVSWFFSRVGVILNQDRSSGWLLGIQNICSSRVVRRLSLVESNCFWFNCKVIASLSSALSSWLSRSSNSERVANRVSRSLRSSGVTCSLGCWASRSSRYCCGVASLSRSWFSSNWPRRRSAISSARLWSALILGSACFCL

SEQ ID NO: 33087 - protein, 625 aa, Pseudomonas aeruginosa
MQVSGGSEAPQGASEREFDRKSEEKSGPWAAFRKLHADLADTVAFQGGHGPGQAVPLHLVADHRFAADLVGDEAAQRLLAVDAVELQAVERGHRRQLGIAFQHEVAEEARAEAPVGRLAEQLAEGRQVVFVADHAENVVGLEDGAARRVEQFGAAEQRGDPGPAGHLQLAQGGADAPLFLVQVVDEQLPLAGRVDLQAGAGYRCRIRRHHHPQQPGRPGQAGALHQQRDQDDEEGHVEEQLGVRQAGHQREHREDDRHRAAQADPGDEGFLAVVEGAERDQSDQYRQRSCHQDHPQRQGQCRQGDRPQVVGGDQQAEDQEHADLRQPGHAVEHVQDAVAAADRAVAEEQAAQVDGEDAAAADGVGQGEHQQAAADHQQRVEAAGQVHAVDQLQQQPAAAKTEQGAETELLHQVQGEAPAEAGLAAGEHLDQGHGEEHRHWVVAARFDFQGRGDPLVETFAAEQGEHRGGIGGADDGADQQAFHPVQVEQPGCRDAGQAGGHQHAQGGQRQCRPERHAEAGDAGAQAAVEEDHGERQVAHQVGHRIVVEDDAADPVVAGDHADGEEDHQDRDAQAGGQRADEDAHADQHRPDQEEIIDGDGVQGRPPRGGTGGRRRYGSVLRRGIT

SEQ ID NO: 33088 - protein, 485 aa, Pseudomonas aeruginosa
DSDSGSIRRGWKALPSHTGCMVALDTPRIATSGALTIGVKPVPPMWPRLEMVKQAPCMASAESFLLRALSASSAASAASCRRLFRSTSRITGTSRPSGVSTAKPMCTYFLRISALPLGASELLKSGSSLSRWAQALSRIGSTVSLTPAFSAAAFWATRKASMSVMSDWSNWVTCGTFSQLRCRLAAPTCIRRVIATSSTSPNLLKSTSGIGGMPAPPVAPAPPDLARCSCSLTKTWTSSLRMRPLGPLAFTSLSSTPNSRASMRTAGPAWTLAPSRLGAPTGAGVSALAGAGAAAAGFCSAAGAAAWAGAAAGCSSAAGAAPSTFSLRIRSPVPTSSPTLIETLSTTPEAGEGISMLALSDSRVISDWSASTVSPALTITSMTLALPAEPMSGTLMSWTLAAAGAAGLLSLGAGAGASAFGASGWAGAASALASAGCSPPSTSSSRISSPSFKVSPTFALMLFTTPALGLGISMLALSDSRVSRL

SEQ ID NO: 33089 - protein, 319 aa, Pseudomonas aeruginosa
ETALWIQFLVVKLHFDCRCQAIRPDVEPFRRCASSLWSSVGSPNRIDHEPAFAGESAGHPAARRRTRRDCPPLRCRRPRCRRPGPPGGLARGAPGGFPTGRRGQRFRRRAGSARPGDAAGSGRTRRAGEPPRARRIAQPVAGAAGGLRRRGRTRSAPATFPHTPATAHHLARPDPPRRAGGNLSRPVGPGRRLHRPGLRVAPSAPVRAVRHADRPALRRTAADGGPRHGQAGRGGAQPVVGHRPDLRLPGGRRDRGGEAFAGQPGVLHPPGAEADQGAGCDHRRRLRLPRRHAPASLRLQRTAGLQLRRAGAVLPGPGA

SEQ ID NO: 33090 - protein, 460 aa, Pseudomonas aeruginosa
LGALRDDQGAGGRRRPAGRRATARHAAAVRLSALPGLFRHRGAAHHEAADPAGGPAQGDVGKHQAGRRRYPRGGVHRPGLPVDPWRARPELAATAAAEGAGDPGGAGLPAAGGGRGAARRLRVPALRRACHPGAGRPADANAAQRRIRPHPRGLHHGLRQLGRIPRAPEPLAGAHRLALPPGDRRPGRGRKRRGGLRQRRRRVDPAVGGGAGRGVGQPATGRRRLRRCRGGLEASQRSAPRPPGTSDAASRPGAPGCLRSAPAGDDRGKPPAGPGAGAGPAAGGSGGAAFRLPGVADREPRRAGAPADPLRGQPDGCRADRAVPDSARRAAQRGAPVPSSTGRRAGRRAARTADADSRGRPRAADGDPSSLQAGPRAAGGGLGDRRHAAVDEGQRLPDLAGRGDPRRGPRTGLAAVGAASRPAVARRRHAVRSGLRHRRLRQGRRAGVRPWLGPRPGVHP

SEQ ID NO: 33091 - protein, 540 aa, Pseudomonas aeruginosa
PPGGARQVRPEPGPPGAGALSRRRVRRGQALAGGTLRRGRRGEDPCRLAGLAVRLEERPSRWRGDSPAPDSGVARGVLQSCRGDFAGRGHRPDVLRWRGGVQRFRPDARGGRAGSPAGGRLWLHLAAVHPAAGGPGGDRPPQSRVQPVLRAHLSLRPLQLPPRAAAWPGIASPGAAGRRPCRGRRMRVLLVKTSSLGDVIHTLPALTDAARAIPGIQFDWVVEEGFAEIPAWHPAVARVIPVAIRRWRKNLWQTLRNGEWRRFKQRLKEVDYDLVIDAQGLLKSAWLTRYVGKTPVAGLDRDSAREPLASRFYRRAYPVAWGQHAVERTRQLFAQALDYPLPESVGDYGLDREQLADADPGAPYLVFLHGTTWDTKHWPEAYWRELAERMCERGWSVRLPWGSAAERERAGRLAAGLENAAVLPRLSLAGMAKVLAGARACVAVDTGLGHLAAALDVPTLSLFGPTNPGFTGAYGRSQVHLGSDFPCAPCLKKTCTYQPTEEDRKLFDLKREQPLCFTRLNPQRVATQLEAMLLAPETLR

SEQ ID NO: 33092 - protein, 309 aa, Pseudomonas aeruginosa
QGSGGIVFLCAGHRTDASRQATLPAHLFPPAVARDTARRGRPAGLDGTQGGKTLRTQAALRRPALMAGWTLEPDYRHLAADFGSLDSVFALEGERLTRDPLSEVIRIERDGVRYYVKRYRSAGKGLRRYLARPRIKAEWQNLKRFEKWGIPTAEVVAWGLERKAGAFQRGAMITRELPGTEDLSVLACNRDPRLKDPRWVDGVSRQIAKATRLMHDQHFTHNDLKWRNLLVDDQPLVYFIDCPNGAFWWSFMLRYRITKDLACLDKVAKYHLSRTQRLRFYLQYRRRRHLNESDKKRIRQVVAFFEGRE

SEQ ID NO: 33093 - protein, 183 aa, Pseudomonas aeruginosa
STWRRPARSGSAAATRSRTWSRCCAVPRTGAKRTCTNSSPPMSTNPSTRPRSSSGIAFSTSAVGARSRADETGRTASRRAPPATAIAGDPGGWRWRCRTAPGQSAAGAARAALRRCRRMAWAQGAGQAAGGRQGRTAFPARTGRGASARGPGADHPGAAGRRAAAGRGRLAAVRLPRRGAEPR

SEQ ID NO: 33094 - protein, 146 aa, Pseudomonas aeruginosa
RSCSSSRRPATPAPRSARRPTCRTSAACRWRRWSTSTSARSIPTRTSSPPAPVTRPGRSGRRSTTAAGVSAGSLPTATRWPGSRDAWSSVRVPSVAAPFSAARACRAWPTGSMRRSSSASAGGPSARRCWIPSARRCSRSTTRPRS

SEQ ID NO: 33095 - protein, 384 aa, Pseudomonas aeruginosa
RRAWTGMTRSAEPRVLQFCHGYDGPFLDCARQYASLFAGTPYKVTTVFLTGRSDPEVAARCASDEVLFLEYGSRDIRGLKLKAIRDLREIARSRDFRFCIAHRFKPIWIASLATRLPIVGVHHAFGDYQRLSRKVFAGLMSKRLSLLAVSDAVRDDIRRCLPKWPAERIETLYNRIDVAALQAEQVERLSARRQLRLPDEAWVVGNVGRLHPDKDQATLLRGFAAALPRLPQNSLLAILGSGRLEEQLKDLACELGIGERVLFLGQVEEARRYFKAFDAFALSSDHEPFGMVLLEAMVAGVPLIATACGGAREVVEGVGILFPLGDETALAEGLTHLAALDRRQREACARLMLERLETRFSDAAVRREFWRLPTIAGFASESAC

SEQ ID NO: 33096 - protein, 301 aa, Pseudomonas aeruginosa
RTGKVVVMALVDDGSQPLVSVIIASYNHEKYIEASIASVAAQTYRNVELLVVDDGSSDGSVELLRGLQAKYGFDLRVQQNQGLSRTLNEAIARARGNLIVPFGSDDIMLPQRLEKQVAHMWDKPEVGICAGNIEIIDSNGRVMPGKEQRKRDLPFRRLDFDDLFLDRKPGPMAPTLMFRREALEKVGGFDPDIRLEDVYIELAVTKAGYVIDILGEVLAQYRKHPTNTYKNARFMVDNVFKTYSQFSDHPDYEQVIMRFRNSMFLKCSNRDKVLARELLSGLPLKYWNEKTFRGIARLFFS

SEQ ID NO: 33097 - protein, 447 aa, Pseudomonas aeruginosa
ALPMRRRMIRASHPAWSKMPMSTDVQGRALAVLNRVAQADWPDRFNLRKPFEKLLYSGSRTGFRLASERSAKQAKGPRKADPDGLFDLSFSDDQQMLVDMLEGFALEVLRPLAHDADAEASLPAELLNQALELGLTHYGVGEVHGGMAGERTTVTTALIAEALAKGDLTLAAALLVPLSAANCIRRWGSPSQQAQWLPAFVSEEGAPLTAIAVNEPSLLFDPQKLATRARRKGSHYLLSGEKCLVLRGLEASRLIVAAKTDEGPALFLVEASAKGVERRAEPAMGLKAGGTARLRLKSVKVPADNRLAAEHFDYRAFLDHAALAWCALALGTGQAALDYVIAYCNEREAFGEPISHRQGVAFMVADIAIELDAMRLMVWRACALAERGQPFQREAYLARLLCAEKAMKIGTDAVQLLGGHGFTKEHPAERWYRDLRAVALMAGGLHL

SEQ ID NO: 33098 - protein, 418 aa, Pseudomonas aeruginosa
TRASARSAATSERGIDMYLETPKKFRSLANQAHQVAENYFRPISRKYDKAEHAYPKELDLLAALLDGMNSGSPEAVGATSASKRAGKQVEEGIKNGGNLSALLGVMELCWGDVGLLLAMPRQGLGNAAIAAVANEEQLQRFGGTWAAMAITEPGCGSDSAAIRTTATQDGDHYVLNGEKIFVTSGERADAVVVWATLNRNLGRAAIKSFVVEKGTPGMTVTRLEKKLGIKASDTASISFNDCRVPAANLLGNAEVDVQKGFAGVMETFDNTRPLVAGMAVGVAKAALDRTRELLKKAGCKFDYRKPLLTVSHAEATLYRLEAEWEAARLLTLKAAWMADNKLPNSKEASIAKAKAGRVANEITLKCVELAGALGYAEDELLEKWARDSKILDIFEGTQQIQLLIVARRLLGKSSSQLK

SEQ ID NO: 33099 - protein, 538 aa, Pseudomonas aeruginosa
KGRQSPPGSGAGAVAPTAGLVAVAGWPQCQPVAETDAFLMHQPAVLYGKALGQPQAAGGRRAQLALAQGEQVAGGAPLVQRQQVEIGAPTVQTRHQRTALEPLVDMVEARLARIARQLQAHVVDQLQRGRGQVYVGAWALQQAQAAGLHRTGGAGQRGEDEVAVLPVAQRTLVGRRQPGVAEAPAEPAAGGLHQAFLGDFLDRREQRQVQFVGRYVAGDQLEHGIAAVQPALTDQHPVVAALPVQGQAHRDPQVGQLGDEALRVGYLHAAAAYEHLLEVQRQAEGLVDQPVRGGLHQQRQGLEGGRILAGEHTGHTGLLVGSSRRGGTEAHVRCTGHRRRGRQAGYGSFGRNMAAECTAGVNPRMLQPMYGSGLFQGLRGHRDIMGQVQRIDGADDGGGDARLVEDQFEAGTHRVLSGAQAGMPAGQRLLHQDALGMGRGVLDDRALGALVQVVGDHRAIALAQGAQATFDGLAGESVGADQALALERGESRVDLAVLEDIQVVAIGMHQHQLDPVSLQALQAALDGAPGMRGGEVED

SEQ ID NO: 33100 - protein, 635 aa, Pseudomonas aeruginosa
  UNSURE (291),(296): Identity of amino acid at the above locations are unknown.
LAVDELFADLADDHPMFALAAQQRAEAFLAAAVGRGGVDQVDAEVAGQGQQVGGFAVVGDGEAGRVLHSLVAAELDGAQAQRRNGQAGVAQRAVQVVEGIPDHAKATSQAGSASGGRGSCGSAACSLGRMPSSSRRAQTRSAKSGASASLVGQPTSRRPCSARKALSGRNRLDCAGSARSTRKVAHCAWPRSIQGSSFASSRRASAICAASSRATPSASAMSPPRYQTDWPSRVGWVVTVIRGFGPAPRQWAYSGFRVAALTITMCSGRRCMAGCSRPSSRSSASLPATGXEHHAXGTILPAVDAQAGQFPAFAQRFDAFAGEQAVAGQFRQAANQVGDVEDDFREAVGLALEPLVAQRRRQIFALGLLDPTAHSLAGEEAGKAAGQAARRPQVVRLGKQAHAPQVEFAVAAETGAPAPRHVGDGFGGAGQGTMQGVLGAAVDDPLRLHALSATEAGAFHQHGGVAGPAQAGVQPEAGDTAANDEDVGGKGLGHGAALSGTERAQYTTCARDGRSVPRSAGEQLDHQHAGDDQADAEEGGGVQALAVDEHRHQADQDDAQSGPDGVDHADRQGAHDQHEHAEGEHVAAHHQQQRQWLAESGDGFQRGGGDHFGGDGDGEVEIVGHGGVLRKLRPF

SEQ ID NO: 33101 - protein, 295 aa, Pseudomonas aeruginosa
VMQWNLEQIRLFVSVAERQSFSAAARELKRVQSAVSNGIALLEADLGVTLFERSSGRQPRLTDEGRVLLAEAREVLRQCERLQGRALGLARGEEPRLRLAQDEAMPYQPVLDSLEALAQRFPSLEVQVSSGGQGDVTRRLLEEQADLGLLFHHERMPESLERRRLGSVEMVTVCGAGHPLAGLQRVSRRELAQHRQLLIVPQQSGYPGGEQISPQVWRLDSFYSMAELLMRNLGWAWLPRHVVQYPTYDRLMVELTSDWTPPALVVELVWRRNEVLGPAAAWLGETFTRHLRAIG

SEQ ID NO: 33102 - protein, 454 aa, Pseudomonas aeruginosa
TGAGNSRLASFLLFSRRASETGYEFTISKKSTCFFKIDWIVSVPWPLPGGSLRSTPQQEQEETHMNRSFPLRRAASARPHPVFPCRVLLGAVLLAFGGLAPVQADDGLVVVGYGGAGQKAQEVAFFQPFTQQTGIPVVQSEYNGEMARIKVMADTGHADWDLVQVEGPDLARGCDDGLFERLDWQAIGGKQQLIANAAQECGSAALVWGVAIGYDADRLQQPPASWADFWDVQRFPGKRGLRKRAIYNLEFALLADGVPREQVYPLLATRAGADRAFAKLGQLKPYIQWWEAGAQPAQWLAAGDVVMTSTYTGAHRRRPPRGAQPGPGMAGQPVRHGLLGGGQGFEARRRGASLHRLRQCPGCPGALRREHSLRADQPPGRPASARATGELGADRAGEPGAGPGDGRRILGRARRGAGGALQRLGQPVRRAPRNLRSSGLPAGGRGRRAGAAKG

SEQ ID NO: 33103 - protein, 117 aa, Pseudomonas aeruginosa
YWPTARPRAIATWRFPPSRCCARTWRSSTTASGRCASNPSATSPAIAAGCCSAKATGRTSTASSAATATSNGFPTADRTSASWCASASTTSPTNGAPARCSPSAWPAARTSVRCPNR

SEQ ID NO: 33104 - protein, 155 aa, Pseudomonas aeruginosa
RPSRRRAVPAPGVDQPAGQRGEVHRGRRGARSRRAAGAQRRKRAPAAERRGRWNRHSRGNARTHLRTLHPGRRRRDPPLRRNRPGPGDQQAAGGSAGGTDRRGKPGRPGQHVLVRDRAGAGELVRRDAAGGIGVCAGGAAGGGRGAQPRGGPGPA

SEQ ID NO: 33105 - protein, 204 aa, Pseudomonas aeruginosa
AGRPPGDAGRGRGAGPGVVPAAALRPDPAGHAPAGDGWPRALRRDSPAARRPEPLHADLRLHRQHPAGHGASVLRRGHAGRARQAPADGRAAPRAGRGRHQRACACGGGRAGPANARDPPPPAGAAQARRTAGQPAGKPGRAVAAAGRSPGPGGPGRGGEHRPSPVRKLPLHGPGGARRRPGRAGARGPGRGRGRPASLGRTPG

SEQ ID NO: 33106 - protein, 87 aa, Pseudomonas aeruginosa
PAPRRRRSPAPRRLPRRSRLSGRLSGAANNFLTAFYIFDPRVQRRLTSAANNPLIRAQDTASDRVETRIMSHLEDPCAYPHPEVRHG

SEQ ID NO: 33107 - protein, 532 aa, Pseudomonas aeruginosa
RQGKAATHPGPGEPPHLHAVPRRGDRHRPVHGLRRDHQPGRPGRRGAGLPGGRGADVPGDGLPRRAVGADAGLRFVPGPRDAFHRPGDWLHDRLGLLDELGLHGRPGIHRGRDAHDPLVPGGARVAMVGFLRGRAVLSQCPGDPRLRRGRVLVRRDQGGGDPGVHRGRGAGDLRRYRTEERCAGADVLQPGRRAAVPQRPVGGVRGDDDGGLCLPGLRDHGRRRRRDRATGEEHPAGGAQRGVPRTDLLRAGHRRAFRHHSLATGRADGKPVRAGVRHGRDSLRGGPDELRHPHRHPLGRQLGPVRLDADPLGDVQDRHGPARPVEAQRARRTALRVADHPVLRPALVADQRGRRRHPVHGADGGERDVRHRHLDRHRLRPIPLPPRAHGQRRHGRRTEICRAAVPAGAAGLHRRVLLAVRLPRPRSHPAAVLVLGLRLHRRLLPGLLRGSSPAAAGTGRPRPGTGRLNGHSQDPTPAASGGRFRFRLVGLFEVVTAGSRGPSPLFGGSHGVWLCACRRAVTYTRMGGLWSY

SEQ ID NO: 33108 - protein, 464 aa, Pseudomonas aeruginosa
DGRRLRCASRQRPDLRLRPDQAPAARRRRALAGRAVACRAGRRAALRAQRGCRRGAARRGRETFPSIQRALGAEQVIPMDFRLTQEQDMLVEAVRSFVEKELLPHEDDVDRADAVSPELAAQIRGKALAAGFYAFNMPEEVGGGGLDYLSQALVERELSKVSWALHVFVARPSKILMACTGEQLGDYLLPCVQGEKTDCFALTEPGAGSDANSIKTRAVRDGDAFVINGSKHFISHAGHADFAIVFAVTDSYEHNGRKRNAVTAFLVDKGTPGMTVRRGPKCVSNRGYHTYEIFFDDCRVPASKVLGEVGKGWEVANAWLTAGRVMVAANCVGQAQRALDLSLRWAADRKQFGQPIGSYQGVSFKLADMATQIRAAELMTLHTAWKMDQGTMTDGEAGMAKLFASETLGKVADEAVQIFGGMGLMDEGPVERIWRNARIERIWEGTSEIQRHIVSRELLRPLLR

SEQ ID NO: 33109 - protein, 718 aa, Pseudomonas aeruginosa
SPGSPLPPGERGRLPCSESRTDMNRENLKRLLAPRHLAFIGGRGMARALKRCAEGGFAGQLWLVNPQHAELEGVPCVASVADLPCGPDAAFVATNRELTLDAVAALAAKGAGGAICYASGFAETGEQGLAVQRRLLAAAGEMALLGPNCYGLLDYLHGAALWPVAHGGRQVERGVAVLTQSGNFAYNLSMSDRSLPVAYMASVGNQAQLGIAELMDVLLDEPRVTAIGLHLEGLKNVPGFARAAYKALQKGVPVIALKTGVSEIGAALALSHTSSLAGSDALYDSLFERLGVIRVSGPVSFVETLKAAACGHLPGGPSLVALACSGGDAGLIADYAERNGLGLPSFDAEQRDELAGVLPDYANIANPLDFTTAIWGDAAALEEMLDSALRSPADAALLVLDYPGEETGERPQCDLLLQRYCAALKCHGKVGFIASAFPELLPARARELLHGEGVAALQGVEDGLAAWGRIARYRQRRAALLERGEAALVPICPGPLAGDGYLLDEWQSKQALKPFGLPLPQGVLSTPGQAREAALDLGFPLVLKAVSAALPHKTEAGGVALGLRNEAALEAALFDMRESLARHAPQLVFERVLLERMAGAPLAELIVGVKREEGFGLALVIGAGGILVELLRDSRSLLLPTTDAAIRDALLSLRSAPLLSGFRGRPAVCMEALVAAIRAVAEFACEHAERLLELDVNPLLADAEGALAVDALIRLANG

SEQ ID NO: 33110 - protein, 410 aa, Pseudomonas aeruginosa
SNCGTPVRADRRTRRASMRYSDFTQRIAGDGAAAWDIHYRALARVEQGEEILLLSVGDPDFDTPAPIVQAAIDSLLAGNTHYADVRGKRALRQRIAERHRRRSGQAVDAEQVVVLAGAQCALYAVVQCLLNPGDEVIVAEPMYVTYEAVFGACGARVVPVPVRSENGFRVQAEEVAALITPRTRAMALNSPHNPSGASLPRATWEALAELCMAHDLWMISDEVYSELLFDGEHVSPASLPGMADRTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 33111 - protein, 230 aa, Pseudomonas aeruginosa
SSTPTTNRNPSPARSVTRHARPWQARGHAVQVSDLYAMNWNPVASAADFAERADPDYLVYALEQRESVKRQSLAADIQAELDKLLWADLLILNFPIYWFSVPAILKGWFDRILVSGVCYGGKRFYDQGGLAGKKALVSLTLGGRQHMFGEGAIHGPLEDMLRPILRGTLAYVGMQVLEPFVAWHVPYISEEARGNFLRAYRARLENLEQDVPLRFPRLEQFDALLQPLAR

SEQ ID NO: 33112 - protein, 301 aa, Pseudomonas aeruginosa
RGLRAALRPAARLRGAHRAIPRRGDAEARQPLAAGAGRRPDRQGRATGGSGPSRGDGGGRADPRCALADNPVPAVAGRHRRGGAPVRRPLRQRRRRRRAWLAGGGRGHPRPRLAVGRCAAGRARRADQQRGEHHRPAVAGPEPGRGAWAMGLNLLRERYRVDLASLQATCEANYARLMRLLPDMREAQASRRVALSEGERLLGVLALEVTEACPYTTTLQVRQELGLPWLPAPRLEVRVYHDARMAEVIGAEQARRLMAIYPYPNQAMHQPDEKNQLNLFLGEWLAHCLACGHEMVPVAQR

SEQ ID NO: 33113 - protein, 323 aa, Pseudomonas aeruginosa
AVAGKRPVEWHQAKSSPRNCDLFRFPGLPPLSSVTIITPFTADASPSGDGPLSRHSNTPATDASVLLVQLSDSHLFAEDGARLLGMDTAHSLEKVVERVAREQPRIDLILATGDVSQDGSLDSYTRFRRLSAPLAAPLRWFAGNHDEREPMQRATEGSDLLEQVVDVGNWRVVLLDSSIPGAVPGYLEDDQLDLLRRAIDSAGERFLLVSFHHHPVPIGSDWMDPIGLRNPQALFDLLAPYPQVRCLLWGHIHQEFDRQRGPLRLLASPSTCVQFAPGSSDFTLDRLAPGYRWLRLHDDGRLETGISRVDDVVFEVDYDTAGY

SEQ ID NO: 33114 - protein, 250 aa, Pseudomonas aeruginosa
HAPRPRDAAAACVVADRRAGWKMKPGSWYRSAFPTELKPISPFPMTATSPSLLYIHGFNSSPESHKARQLQAAFGHLGLAEGLRVPALHHHPRQAIAQLERAIAELGRPVLVGSSLGGYYATHLAERHGLAAILVNPAVAPHRSFDGYLGAQTNHYSGETWELTEDHVAALAELEVTRLQRPERYQVWLQTADETLDYRAAQAFYRACALRIQAGGDHGFQGFARHLPALLAFAGYPSALWRDTDFSTFD

SEQ ID NO: 33115 - protein, 446 aa, Pseudomonas aeruginosa
PPVSPATLGRRLRPALAGRGREFHRSDPAGQRVALGHEHAGLAQWPGARRQPRLRRHRLRCRRQSLPGQRGARGGPATAGERRAELAAPAARPAVASAGQRHADEFQRAVRRDRRRPRGQAPLAGCRARAPRPAGGPPRQQCLALRGQLRTARRGRQDRAAAGTGQRAQAAEGFLRPRLLPRQAVHPGAPGASDLSPRPGPGQGRALLVVRLGGPGAGASLRAALWRRGSPVAGRQGRLAGHRQWRPCARRWRRAALRPALRRARRRLVGGQVTQRAPGQRLGRIMLVLAWIAGLALATRYFGVWEDRQRNPNQAPQSIHGDGYVELRLASSRQGHYLLNGQINGQGVTFLLDTGATQVAVPEALAARLALERGAPITLSTANGRATGWRTRLDQLQLGDIRLSGVAALIAPGMDGDEVLLGMSALKQLEFTQRDGTLVLRQNTSP

SEQ ID NO: 33116 - protein, 429 aa, Pseudomonas aeruginosa
LRRHPGRAGRAAGPPAQPAAQRHHRHRGGHGHRRAAAQPAGSRVGLRAPARPAGRDGRRIVRTRAGPGLPHRSRDHHPARRPAEGLRDRPRFGAHARGVPRRGRRHRHPRPAAPGVRFQGAGTDRRADAGQEAADGGRPARRVGPREPDPHRHHPAFEPGRCRRADDPSVRHHRPGNQLPGQPEHHRPRRQAAGQGPAPVALGVAAVPHRHRASTPAVPPGQGRAPPASAGWLADRLPQPRRGDPHHPHRGPAQGGADGALRTQRGAGRLYPRHPPAPVGAPGRDEDPRRAGRVAEGAEAPADPARQRGQAEEAGARGADQGRRDLRRRPPFADRRPRRGPRAVGNRADAHRTGDRGALGQRLGALRQGPRHRRRRPFLQSRRPLSCRRAGTLEPVCGVHRLHRGAATRCRPHCLPSARGQGEPLRRPG

SEQ ID NO: 33117 - protein, 254 aa, Pseudomonas aeruginosa
NSSLASVVPIFGEIRWFSMSAWRVFACLSLVSLLGLTGCAVHPPAQLYQLDVGAAAVPKKDGGAAVLLGPVQLADYLKRDVMVQRQADGILSLSTEARWAGNLETNVSQQLLRQMSSELGSSRLALFPEKPGFTPQVQVMLTISRLDSGPKQPAVIEARWRLLDQKGDLKDSRVFHEEEQHQGSIGDQIRAQSDLLKRLAAQLAKDVKPIAVAAEAPPPATARKPVAKPKVKEEEGPKMPLVVPIRTDAEVYRF

SEQ ID NO: 33118 - protein, 194 aa, Pseudomonas aeruginosa
RCRRSTRRLRGNRRNCSWAPSWIASTALCCGSRAAAGAAGCSPASAPFSSKASWSSGSSSMEVNSTGLVSSSRASPSGMSSSSKAEASTLRLRRSASSSSSRMSSKFCGSGASSGSGAGGFSGTRRSSRSRARSPSSFCSSAPGAGLSGSRNQTRNCNKGVEICRPRRRLKYRARISRIRLIRPMLCRLIIIGC

SEQ ID NO: 33119 - protein, 431 aa, Pseudomonas aeruginosa
WQMPGSASLGCAGKRVEWRLLPGGAYALREIVLINITGEDRPGLTAAITGVLAQGGVNILDIGQAVIHDTLSFGILVEIPDTEAGSSVLKDVLFTAYKLDQQVRFTPVSEEDYRQWVDGQGKARHIVTLLTRRVTAEQLQRVSSITAKYALNIDHIDRLSGRMPLDMPADQGKGCIEFSVRGEPADPAALRAEFLSVAQELNVDIAFQQDSVFRRNRRLAVFDMDSTLIEAEVIDELAKAAGVGEKVAAITERAMRGELDFRASFKERLALLQGLSEDVLEEIGASLRLTEGAETLFAELKRLGYKTAILSGGFTYFARQLQAKLGIDYVFANELQIVDGKVTGVAVEPIVDAQRKADLLRELAAKEGLSLEQTIAVGDGANDLPMLGLAGLGVAFRAKPLVKQSAKQAISTLGLDGILYLLGYRDREGRA

SEQ ID NO: 33120 - protein, 541 aa, Pseudomonas aeruginosa
VMASTELSSSNWQRFSASRRASSAARRARRSARPASSRLATSTRRSSSPCGRASWAPSIKASVMASELLSATSWMNGMSRDWRRKVASASPGSRHSLVGAAISRSQLCWRVSARSSGEVSRCTRVAWPALRNRLTRRSASFCESSRISRRMVFFSMAMERAQSASGQARKDGEWRGRGNLQRLPERVKIFLPRRRPGHWRCDRLIARGVHRFRRAVFELAEAAGRGLPAIQHRAPLLAVQVDLHPAALLERQARGDHRRRPRDRGDRRQQQGAQVVAALLGLAQQLQAAGLCRRGDHLDAHLRAAIAYLADPAHHRDAPRLAWKVLQADQFARLQLGGHLLRPAQAIAAGAVVDDGQGVGRVVLGGVSLCVGLRVPGLHTAGRLVRAVLDFLQRHAGLPVGDLLCIEGAGPGVLDVGLEARRLGRFLDLQDLVERAAPGEEVVQGAHADAQGQLALALGALEGTFGDVTPGRGEMLQQVQGHPFDQRQACFRAFGLGLQQVFADQLDQRLGVDAQGIGQLGLRVQRTVARRAVDLRHGDEQ

SEQ ID NO: 33121 - protein, 536 aa, Pseudomonas aeruginosa
QHRNGPAAFGRHDPAGRFRRRGETGRRRSGRSAPARSGLFRQGQAFAHAHRARCPEAVVERDLLRAEQDDGGGAQLEATELGAFFQADRRTGGFVVAEGLQFALRRRNEAGPDGFDGGYDHRAYQHHGHRTALGVEQADHPLVAGEQLGNVFRGGLVHREQPAGNVDHLAQGAGQRHVHAVVVPGGQVDGGEVAAHEGRGQFGVAAEQFGQAVAVAFGLEDPPVLDRAELADRAIGRAEHRAGLLGQRAGAILQGAGEEGIEMFIGLQVLDLRFAHIDLVAPGEPGDQAVLEPGRPAVGGEADQPGQQVVRQQVLAADEQTIFERHSSNLYRGIGVVAPFRPGAGVAFDPRVAQRLGHQVGEAGAMVGLAVGDHFLVRRDAEVLQDFGDIRADAQGASRVHAGGPFEIDRAGHMPGLRGEHLGTGVFAGVARIPYRQVGGAEAALQVFAGRTGLVVQRQRLRAADRRRDLAVERLGVGDPGRQAAVEIVVVVVADHVQQPDEAARPAAAFVVVDHVGRLRAVAQLAEQGFQVGLRR

SEQ ID NO: 33122 - protein, 230 aa, Pseudomonas aeruginosa
WRSSWCSGCCLRPPRSRRRRFPDTSRTPSVSAKAPAPTSSTSAARRRRRRTRPSIRRFRPSRTPTKAGSAPSRTTRSTPIRPRTSPSRLSESVWRCCCRSCRTRSTKIRCSRTSRTRSTSRSPATACASRSSTPPTGRCSTSAARACSRISRTSCWPWPRPSARCRTRSASAATPTPSPMPATATSATGSYRPIAPTPRAVRWSPAAIRKGRSPRLSAMPRHACSTTRTR

SEQ ID NO: 33123 - protein, 119 aa, Pseudomonas aeruginosa
LAMRCGMMRPSSKAWSRAQPGSRSCLQSRKRQCPSRSRNSMKPASTSSRDTCPRPNSRMPGESIRSPPPGKWNSRAVVVVWVPLPVTVERSPTRVSTPGNKAFTSDDLPTPDCPTKTLT

SEQ ID NO: 33124 - protein, 103 aa, Pseudomonas aeruginosa
RSGCSLAMRRHGSASWCSTNSVATPSCCKRSSPGLAAWREMPLPRLAARPRTAHKGLFGHLLVVGGDTGMGGAVLLAAGKRPCAAAPGLVSAATRGRTCAGRC

SEQ ID NO: 33125 - protein, 253 aa, Pseudomonas aeruginosa
RPWRPWPGRVAREEHHPVDRSRAATPDQPGARLPGRADPYRRLFHPAAQAHRDRPQEGRRPVRLDPCRRRAEPQRLRCLGVRPVRPRRHFGNRALAGRQREPFRPDRRRWQRQPRRQGPDARRRAARPVDDRHPLVEPGCRPQGTDQCRPHHFAAQASCRAGRVHGAEVARHPVDPGGNRLHLERQRVAQAGQRQPSAGLGAFDHQRHPPVFPAEPAARYLHRLFARPGQALHGAARARGAARRDPGDDRPAL

SEQ ID NO: 33126 - protein, 659 aa, Pseudomonas aeruginosa
QQQPVQRQPESRPGPVHPEHRPGGPVMSEAPRIQLLSPRLANQIAAGEVVERPASVAKELLENSLDAGSRRIDVEVEQGGIKLLRVRDDGRGIPADDLPLALARHATSKIRELEDLERVMSLGFRGEALASISSVARLTMTSRTADAGEAWQVETEGRDMQPRVQPAAHPVGTSVEVRDLFFNTPARRKFLRAEKTEFDHLQEVIKRLALARFDVAFHLRHNGKTIFALHEARDELARARRVGAVCGQAFLEQALPIEVERNGLHLWGWVGLPTFSRSQPDLQYFYVNGRMVRDKLVAHAVRQAYRDVLYNGRHPTFVLFFEVDPAVVDVNVHPTKHEVRFRDSRMVHDFLYGTLHRALGEVRPDDQLAPPGATSLTEPRPTGAAAGEFGPQGEMRLAESVLESPAARVGWSGGSSASGGSSGYSAYTRPEAPPSLAEAGGAYKAYFAPLPAGEAPAALPESAQDIPPLGYALAQLKGIYIFAENAHGLVLVDMHAAHERITYERLKVAMASEGLRGQPLLVPESIAVSEREADCAEEHSSWFQRLGFELQRLGPESLAIRQIPALLKQAEATQLVRDVIADLLEYGTSDRIQAHLNELLGTMACHGAVRANRRLTLPEMNALLRDMEITERSGQCNHGRPTWTQLGLDELDKLFLRGR

SEQ ID NO: 33127 - protein, 205 aa, Pseudomonas aeruginosa
ALQLRAQSPKLCALSKSVPMSSLPPAIFLMGPTAAGKTDLAMALADALPCELISVDSALIYRGMDIGTAKPSRELLARYPHRLIDIRDPAESYSAAEFRADALAAMAEATARGRIPLLVGGTMLYYKALARGPGRHARRRSRGARGDRGRGPVQRLGRAAPATRRGRPGVGCAHPPQRPAATDAGARGVSPRRGVDERPASPAKR

SEQ ID NO: 33128 - protein, 126 aa, Pseudomonas aeruginosa
PEGVSRKLRREARRTGARSEQRVLPLSEQGQQVILGSPAGGSARRRNRVMMSQPGNPGFFASARIMWQEFGIAFCLVLVLEGILPFLCPRQWREAVTGIGRLSDRHLRLVGLGSMLLGTLLLYWIH

SEQ ID NO: 33129 - protein, 912 aa, Pseudomonas aeruginosa
RRKGDLPLMADWQNLDPEAAREAEKYENPIPSRELILAHLSERGAPATRSQLLDEFGLAGEEPEEALRRRLRAMERDGQLIYTRRGAYAPVDKLDLIRGRISGHRDGFGFLIPDDGSDDLFLSPTQMRLVFDGDRALARVSGHDRRGRREGQLVEVIERAHEIVVGRYFEESGIGVVVADNPKIQQEVLIPPGKAGKARHNQFVQVRIEQWPSIHRQAQGEIVEVLGDYMAPGMEIEVALRSYDIPHVWPAAVEKEAAKLKPEVAEKDKEKRVDLRQVPFVTIDGEDARDFDDAVYAEAKRGGGWRLFVAIADVSHYVKVGSALDEEAARRGNSVYFPERVIPMLPEVLSNGLCSLNPLVDRLAMVCEMTLSKAGKLTGYQFYEAVIHSHARLTYTKVSQLLEHPDSVEAENLRQQLPGVVPHLQQLYALYKALLAGRHVRGAIDFETQETRIVFGADRKISEIRPTQRNDAHRLIEECMLCANVATARFLQKHAIPALYRVHDGPPQEKLNNLRQFLGELGLSLGRGKAAPTPGDYQELLEKIHDRADFRLIQTVMLRSLSQAVYSPDNNGHFGLNYDAYTHFTSPIRRYPDLLVHRAIRSVIRSKAETPHVQRAGAASMPKARIYPYDELRLDQLGEQCSMTERRADEATRDVTNWLKCEYMRERVGETFPGVITAVTGFGLFVELTDIFVEGLVHVTALPGDYYHFDAVHHRLSGERTGRSFRLGDTTEVVVARVDLDERKIDFELAGNVLSAPIGRKKRNGDKSANAGKAPKGRKGASVPEVDLEPALASPDAAVVPRRKAGKVQALPPVAPELLAQAAEMLGNTDVRKSREVKQALLAEARVGGKDKGGKKGKVVPAGKSAKGKAKDGKPAAAAKPGKPTKHRKGPSKPKADNAPAATGARKRKAKS

SEQ ID NO: 33130 - protein, 142 aa, Pseudomonas aeruginosa
GAFMRHYEIVFLVHPDQSEQVGGMVERYTKAIEEDGGKIHRLEDWGRRQLAYAINNVHKAHYVLMNVECSAKALAELEDNFRYNDAVIRNLVMRRDEAVTEQSEMLKAEESRNERRERRERPNDNAEGADGDDNSDSDNADE

SEQ ID NO: 33131 - protein, 408 aa, Pseudomonas aeruginosa
PSPDLPRHLQAGRGQPADRRGDPLRSSWRRKDNWPRSAGLAYLGELAKNIPSVANIKAYAQIIRERATLRQLIGISNEIADSAFHPEGRGANEILDEAERKIFEIAEARPKTGGPVGISDILVKTIDRIDYLFNTTEALTGVSTGFTDLDEKTSGLQPADLIIVAGRPSMGKTTFAMNLVENAVMRTDKAVLVYSLEMPSDSIVMRMLSSLGRIDQTKVRSGKLDDEDWPRLTSAINLLNDKKLFIDDTAGISPSEMRARTRRLVREHGDLALIMIDYLQLMQIPGSSGDNRTNEISEISRSLKALAKEFNCPVIALSQLNRSLEQRPNKRPVNSDLRESGAIEQDADVIMFVYRDEVYHPETEFKGVAEIIIGKQRNGPIGTVRLAFIGKYTRFENLAAGMYNFEDE

SEQ ID NO: 33132 - protein, 634 aa, Pseudomonas aeruginosa
ARSRLGFRDATATDSGDTLRCQGGRPGERRRGLAFIVGSHRIAGAPGALDPVQRLVGGLVEFAELQGVAGKQGDADARCDHQPLLGELHRFRQFSQQAFGDVAGMLLGIRPADQHGEFVAAEARHAILGAHAMAQPLGHVLQDEVAGIVAMGIVDRLEVIQVDQQQRHAVTVAARVVQGAFGELHQVPAVAKPGQRVVMGGVLQLRFAHLQLAIGLAQLVGTDFHGACQVALGAVQQGQARVLFLVGLVQGQGPFLLQILDARGERQGEQQGLQGQRQREDHGVGRGRLDQRGGAHHAKADAAEHQAEADQVQARRGRTLAPALHCQADGDRQVGQQGQRQHAGRLPAPAGGVERQAGKEQQATGVQQVMGPACVLPALQQVLAEADHADAPDRQQRQAVKPPGHRPLGPEILETMAADAQGQHQRAGSGQHVPEIGAIAQAGEEEQVVQQQGEDQPVGHAEQQVALAAVFQQFVVAPEPQRKGVAAGIVAAQVDAQRPIAGRDPEQRMTVGVVAALGEGHRFAAAMFTEPAALVGEVQAQVVQAGAGDFQPPAAGYRLASRQVEAQPPGAAAEADAGAAGGGDEAAGLLRLFEVLHRQVAIGVFEQVQRAVQPGAAGRRRRKLRRGARNGAGQ

SEQ ID NO: 33133 - protein, 754 aa, Pseudomonas aeruginosa
RYPLVPVMQAAKPLFDYPKYWAECFGPAPFLPMSREEMDQLGWDSCDIIIVTGDAYVDHPSFGMAIIGRLLEAQGFRVGIIAQPDWQSKDDFMKLGEPNLFFGVAAGNMDSMINRYTADKKVRSDDAYTPGGLAGKRPDRASLVYSQRCKEAYSHVPVILGGIEASLRRIAHYDYWQDKVRRSILMDATADILFYGNAERAVVEIAQRLAQGELVSAITDVRGTAFVRRDTPEGWFEIDSTRIDRPGKIDKIINPYVNTQDTAACAIEQEKGAQEDPQEAKVVQLLANPRLTREKTVIRLPSFEKVRNDPVLYAHANRVLHLETNPGNARALVQKHGEVDVWFNPPPIPMSTEEMDYVFGMPYARVPHPAYGKAKIPAYEMIRFSVNIMRGCFGGCTFCSITEHEGRIIQNRSHDSIIREIEEMRDKVPGFTGVVSDLGGPTANMYRIACKSPDIERHCRKPSCVFPGICENLDTDHSSLIELYRKARALPGVKKILIASGLRYDLAVESPEYVKELVTHHVGGYLKIAPEHTERGPLDKMMKPGIGTYDRFKQMFEKFSKEAGKEQYLIPYFIAAHPGTTDEDMMNLALWLKRNGFRADQVQAFYPSPMATATAMYHSGKNPLRKVTYKSDGVTIVKSDQQRRLHKAFLRYHDPKGWPLLREALERMGRADLIGNGKHHLVPTYQPDTGEYQSARRKNSTPAGSKKAGKLLTQHTGLPPRASDGGKPWSKGQQNKATAFAKGKKKSRQPNIPR

SEQ ID NO: 33134 - protein, 841 aa, Pseudomonas aeruginosa
PQPQPREPSMPELLAHYPFTDTAYHELLDRQGGVRPHWQRLFRQLERSSPEQLRQRQALVERQIQENGVTYNVYADPKGTDRPWALDLLPNLLSAAEWQPIAAGVAQRARLLNALLADLYGDQRLLAEGLLPSELVFGHPNFLWPALGIRPPGGIFLHSYAVDLARDADGRWQVLADRTQAPSGAGYALENRQIVSRALPELYRDLRVQHLAGYFRTLQETLASQAAGDGETPLVVLLTPGRFNETYFEHLYLARQLGFPLVEGHDLTVRDATLYLKTLGGLKRVHAVLRRLDDDFCDPLELRTDSALGIPGLLEAVRQGRVLVANALGNGVLESPGLLGFLPQACRRLLGEELALPSLDTRWCGEPQALEAILAALPDLVIKPAFPGQRCEPLFGHALDGAGLASLGERLRERPQAYVAQRLAQLSQAPVWRDGEAGVGLQSRAIGMRVFAVAAADGRYWVMPGGLTRVASAADAEVVSMQRGGASKDTWVLAERAVGGEPWRPRRLGVRDLVREDPYLPSRVVENLFWYGRYAERCDDHARLLRVVLSRYVDADGDEEALRSALALAGGIGLLPGDGEPLERCLLRALLDEHWPASLCANLRRLHWAAAQVRGRLSGENWLALLELQRDMQALDPARTDLGEALDFLNRLVMSLAALSGFALDDMTRDDGWRFLMIGRRIERVRFFAESIAAFLDGGSAWDAGALEWLLELGNSGITYRSRYLASPQLVPVLDLLLLHEQNPHSLRFQLQALERSLERLHEEFGAPRERELRTLGERLRSFDLAALESPLFGAAGLDEVLVGLARLLRDIAACAGQVSDRLGLRYFAHVDDVSQRTVST

SEQ ID NO: 33135 - protein, 294 aa, Pseudomonas aeruginosa
CPHPRFAPFRSRAPATRCCTTPITAMRRRSRCRGNWRISGHANAPGRPVMSGQLLIEPGAEPGREDAHDAFGNPLSRVAFERPHEALRVSARLQVEVFAHAPAQLTASPAWETVAAGLAFSGRALSAAELEACRYRVESPYVRIQRRFAEFAADCFPPGRPLLVAAAALMEKIFREFAFDAQATQVATPLDEVLERRRGVCQDFAHLMLACLRARGLAARYVSGYLLTRPPPGQARLIGADASHAWVSLYCPENGWVDFDPTNDLLPDLEHITLAWGRDFSRCVAAARGDPRRR

SEQ ID NO: 33136 - protein, 407 aa, Pseudomonas aeruginosa
KSPAAAGLFHGRAPGSARVACRHRLAGQLVHAPGRMPLVPEVVLVRVGAGRADAGLGRLAGRVQLHQAIARRVAPQVAAEGEMVEPAQLQAAGLAQGGELDRQAGVDCLQVALRPLDPVTGDHRRDHAQVGRTDHQEASCAGLSETLHRGADVRHAAAGQLFQGLLAGEILVLEEIVGGDEDEVQRLAIDRLAVQRGEVGVDLAGEAGMAVGAHPAVVVVRSALGAAHRMVGQLRTKLAGEHLDGGRAVAPAALPVDFAGQCLGAGDALGEHLAGQSLAFAVVRIAVAEGVELPYRREQRGCVSAGLAGQQDTEEQGGETGAHGWPSQGYSFLLARRRADLKTWLRQAHSRPRQRPVDDGPAARTGRLRAPSAVRACAGSCGRCRRSPAQLPRAAAGRAGRRRSRHR

SEQ ID NO: 33137 - protein, 218 aa, Pseudomonas aeruginosa
NKSSSTCTTKFPQWKVFSMRDEISYRIRRLPAGMSGGRAPDFALAVYGGAFDPPHPGHESVIRRALLCAERVALVPSHRHAFGKRMGDFELRCRWLARLARRIDPRRVYCEPIEAGLMPDCPAVYSIDLLEALAARSGLASPRIALLIGADNEAELPRFERAAELCWRFGRLVAEERLPLHSSMIRQRLREGLAVPEAWCLPEVKDELHCYGGERQAG

SEQ ID NO: 33138 - protein, 221 aa, Pseudomonas aeruginosa
SAAPRRLSPASGPCPACWSTAAAPTTASTTRRCAPLRYQARAGAGLHRAGAHGRQRGTRPARLVAERVLPGAGRSGHPDGGRRPRLRAAARRSQRALRPAVRPRPTGTAGLRAPGEQVGVQRPAAVPAGAALHRGRGAEGLRVRHRPGSPAFQPARAPGADEGGWLGRGHRRTPASAHGAPATRPAFHPEAGRRLRFRPQPAGVLTNGCGRAGEAAPCRAC

SEQ ID NO: 33139 - protein, 357 aa, Pseudomonas aeruginosa
TVKRWICCSSPFASFASSTLEVEVFTAPSATSPILALSESMFWLTSLAVAVCSSVAVDICALLWAIPSTAWAMRPSAFPASWARWTLTWACSRDCCITLTALLAPACRASIISRMVSVALCVLVARLRTSSATTANPRPASPARAASIAALRASRLVCWAMFWMTSRTVLISSVLLRSVSMTAPASPTMTDRPWMASRFACTSPVPVCASLFADSALAAAAWAFRATSWTAMLIWCTAVATMSVWSPWDVATWLTWLLMALISSEVMVSFLAVSARCRSSACWLSSIILKARAVSDTSSRPRASARSVRFEESCTRRITPRRSESGRMIDRLMNQAAATMRTRAAAPMSRKVVRMES

SEQ ID NO: 33140 - protein, 261 aa, Pseudomonas aeruginosa
NGAPWGLPRHARDRPGSRPPGWAGRAARRSPACLRRVPPRPGSAVAGLPRNRPGRRGCTCRRCRSVDRGSNPGNFAPGWRTSRARPPRGWRSAAAPAPPVGSVRPVRRPATGMARRPPPVVRRTGGCTRRPAGCRGRRRTPGRNGPGAGRPVPVPGAGRGGCSGGGGASRSVAGSASARRRSAGSPLAALRSRRRRKAGSGWTALPVAGCVVPRPGTARRPGSVASACAPGGTGRAAVAPRVARPACSWRSGSGSTLRRRG

SEQ ID NO: 33141 - protein, 139 aa, Pseudomonas aeruginosa
SAWPDRIPAPTPPSASNTGAARPRRRKTSTRRVGSTARRSSWSRPTTPANRSRPWPWPTAWWTRTRPSPWSAISALLRPSPHPRSTTRPGSSPSPPVPPTRRSPSADSPGCSACAAATTSRAWSPATISSTCSRPRRSR

SEQ ID NO: 33142 - protein, 445 aa, Pseudomonas aeruginosa
SSVPRACSAARRSPRCKGTTMSNETSIDLKQCVLDAVLSGLIALVVFGPIVGVVLDGYGFNLHYERVGWIIAIVMAGRFLLILYLQTRGGRAVLERFEGAGSGVHVLPPGYKTRLRWIVPLILVAAVIFPFFASKYLLAVVILGLIYVLLGLGLNIVVGLAGLLDLGYVAFYAIGAYGLALGYQYLGLGFWTVLPLAALTAAVAGAILGFPVLRMHGDYLAIVTLGFGEIIRLVLNNWLSFTGGPNGMPAPAPTFLGLEFGRRAKDGGVPIHEFLGIAYNPNMKFLFIYVVLFLVVLLVLYIKHRLTRMPVGRAWEALREDEIACRAMGLNHVLVKLSAFMLGASTAGLAGVFFASYQGFVNPSSFNFFESALILAIVVLGGMGSTVGVVNAAFVLTVAPELLRSFADIRVLLLGILMVVMMIWRARGLIRISRVGFAPRKGVAP
